US007205147B2

(12) United States Patent
Gutteridge et al.

(10) Patent No.: US 7,205,147 B2
(45) Date of Patent: Apr. 17, 2007

(54) NUCLEIC ACIDS ENCODING RYANODINE RECEPTORS

(75) Inventors: Steven Gutteridge, Wilmington, DE (US); Timothy Caspar, Yorklyn, DE (US); Daniel Cordova, Hockessin, DE (US); Yong Tao, Newark, DE (US); Lihong Wu, Newark, DE (US); Rejane M. Smith, Elkton, MD (US)

(73) Assignee: E.I. du Pont de Nemours and Company, Wilmington, DE (US)

( * ) Notice: Subject to any disclaimer, the term of this patent is extended or adjusted under 35 U.S.C. 154(b) by 384 days.

(21) Appl. No.: 10/668,767

(22) Filed: Sep. 23, 2003

(65) Prior Publication Data

US 2004/0171114 A1    Sep. 2, 2004

Related U.S. Application Data

(60) Provisional application No. 60/427,324, filed on Nov. 18, 2002, provisional application No. 60/412,795, filed on Sep. 23, 2002.

(51) Int. Cl.
*C12N 5/16* (2006.01)
*C12N 5/21* (2006.01)
*C12N 15/63* (2006.01)
*C07H 21/04* (2006.01)
*C07K 14/705* (2006.01)

(52) U.S. Cl. .............. 435/325; 435/252.3; 435/254.11; 435/254.2; 435/320.1; 536/235.5; 530/350

(58) Field of Classification Search ..................... None
See application file for complete search history.

(56) References Cited

U.S. PATENT DOCUMENTS 6,808,873 B2    10/2004    Murphy et al.

FOREIGN PATENT DOCUMENTS

WO    WO 01/71042 A2    9/2001

OTHER PUBLICATIONS

Takeshima et al., Isolation and characterization of a gene for a ryanodien receptor/calcium release channel in Drosophila melanogaster. FEBS Letters 337:81-87, 1994.*
Christopher H. George et al., Ryanodine Receptor Mutations Associated With Stress-Induced Ventricular Tachycardia Mediate Increased Calcium Release in Stimulated Cardiomyocytes, Circ. Res. 93:531-540, 2003.
Kinya Otsu et al., Chromosome Mapping of Five Human Cardiac and Skeletal Muscle Sarcoplasmic Reticulum Protein Genes, Genomics, 17:507-509, 1993.
Giuseppe Giannini et al., The Ryanodine Receptor/Calcium Channel Genes are Widely and Differentially Expressed in Murine Brain and Peripheral Tissues, The Journal of Cell Biology, 128(5):893-904, 1995.

Dawei Jiang et al., Enhanced Basal Activity of a Cardiac Ca2+ Release channel (Ryanodine Receptor) Mutant Associated with Ventricular Tachycardia and Sudden Death, Circulation Research, 91:218-225, 2002.
Xuehong Xu et al., Molecular Cloning of cDNA Encoding a Drosophila Ryanodine Receptor and Functional Studies of the Carboxyl-Terminal Calcium Release Channel, Biophysical Journal 78:1270-1281, 2000.
Hiroshi Takeshima et al., Ca2+-induced Ca2+ release in myocytes from dyspedic mice lacking the type-1 ryanodine receptor, The EMBO Journal 14(13):2999-3006, 1995.
Steven O. Marx et al., PKA Phosphorylation Dissociates FKBP12.6 from the Calcium Release Channel (Ryanodine Receptor): Defective Regulation in Failing Hearts, Cell, vol. 101:365-376, 2000.
Andrew J. Dinsmore et al., Characterisation of Antibody Models of the Ryanodine Receptor for Use in High-Throughput Screening, Pestic Sci., vol. 54:345-352, 1998.
Toshiaki Imagawa et al., Expression of Ca2+-Induced Ca2+ Release Channel Activity from Cardiac Ryanodine Receptor cDNA in Chinese Hamster Ovary Cells, J. Biochem., vol. 112:508-513, 1992.
Barbara Bruce et al., Screening for Ryanodine Receptor Type 2 Mutations in Families with Effort-Induced Polymorphic Ventricular Arrhythmias and Sudden Death, J. of Amer. Coll. of Card., vol. 40(2):341-349, 2002.
Gian Antonio Danelli et al., Genetics of arrhythmogenic right ventricular cardiomyopathy, Current Opinion in Cardiology, vol. 17:218-221, 2002.
Meiko Shiwa et al., Molecular Cloning and characterization of ryanodine receptor from unfertilized sea urchin eggs, Am. J. Physiol. Reg. Integrative Comp., vol. 282:R727-R737, 2002.
Yasuo Ogawa et al., Ryanodine Receptor Isoforms in Excitation-Contraction Coupling, Adv. Biophys., vol. 36:27-64, 1999.
G. Lees et al., Cell Culture Approaches to Invertebrate Neuroscience, Academic Press, New York, pp. 123-127, 1988.
Toshiaki Imagawa et al., Expression of Ca2+-Induced Ca2+ Release Channel Activity from Cardiac Ryanodien Receptor cDNA in Chinese Hamster Ovary Cells, J. Biochem., vol. 112:508-513, 1992.

(Continued)

*Primary Examiner*—Ruixiang Li

(57) ABSTRACT

The genes encoding ryanodine receptor homologs have been characterized from multiple insect families including lepidopteran tobacco budworm (*Heliothis virescens*), homopteran green peach aphid (*Myzus persicae*), corn plant hopper (*Peregrinus maidis*), cotton melon aphid (*Aphis gossypii*) and fruitfly (*Drosophila melanogaster*). The full-length genes have been isolated, cloned and amplified in bacterial cells. Expression in insect cells shows that the recombinant protein folds into a functional calcium release channel. The genes and their corresponding polypeptides have a number of uses including, but not limited to, the isolation of other pest ryanodine receptors, the development of screens to identify insecticidally active compounds, use of fragments of genes as pesticides, fragments of protein for antibody production, fragments of protein for determination of the structure of insecticide binding sites, and identification of insecticides that disrupt the calcium balance in cells through other messengers that interact with the receptor calcium release mechanism. Methods are outlined for overcoming toxic effects of expressing recombinant proteins in host cells.

9 Claims, 38 Drawing Sheets

OTHER PUBLICATIONS

Figure 3:
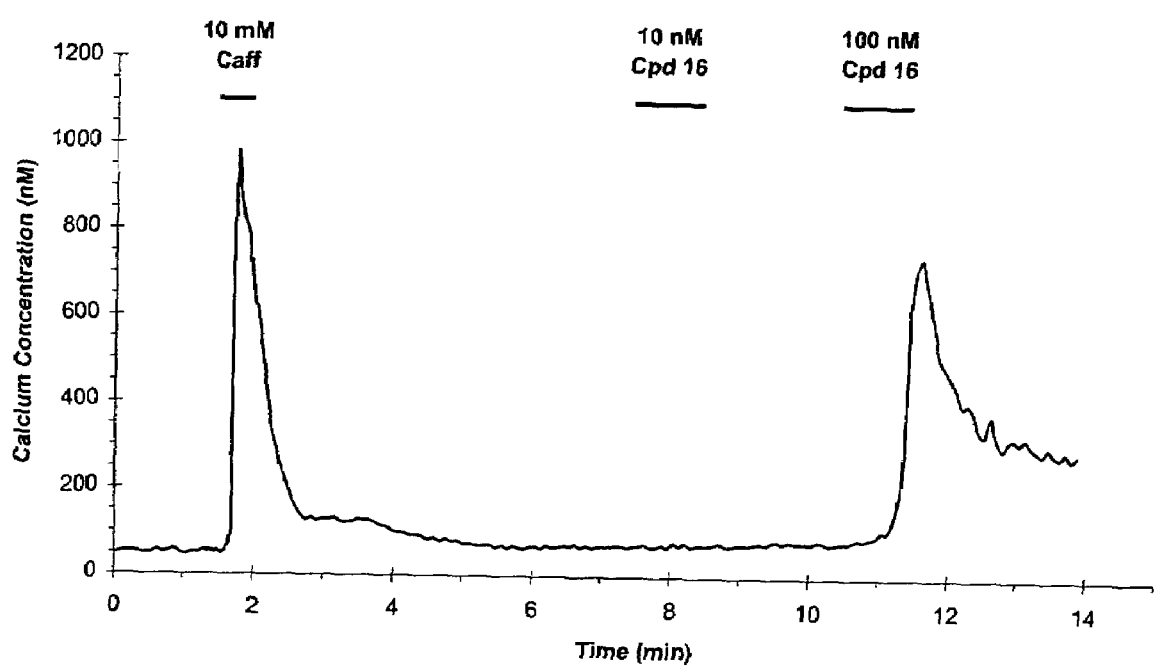

Manjunatha B. Bhat et al., Functional Calcium release Channel Formed by the Carboxyl-Terminal Portion of Ryanodine Receptor, Biophysical J., vol. 73:1329-1336, 1997.

Natascia Tiso et al., The binding of the RyR2 calcium channel to its gating protein FKBP12.6 is oppositely affected by ARVD2 and VTSIP mutations, Biochem. & Biophys. Res. Comm., vol. 299:594-598, 2002.

Isaac N. Pessah et al., Calcium-Ryanodine Receptor Complex, The J. of Biol. Chem., vol. 261(19):8643-8648, 1986.

Elisabeth Lehmberg et al., Similarity of Insect and Mammalian Ryanodine Binding Sites, Pesticide Biochem. & Phys., 48:145-152, 1994.

Hiroshi Takeshima et al., Isolation and characterization of a gene for a ryanodine receptor/calcium release channel in *Drosophila melanogaster*, FEBS Letters, 337:81-87, 1994.

National Center for Biotechnology Information General Identifer No. 456161, Accession No. D17389, Mar. 25, 1999, H. Takeshima et al., Isolation and characterization of a gene for a ryanodine receptor/calcium release channel in *Drospophila melanogaster*.

National Center for Biotechnology Information General Identifier No. 1871446, Accession No. D45899, Dec. 25, 2002, Y. Sakube et al., An abnormal ketamine response in mutants defective in the ryanodine receptor gene ryr-1 (unc-68) of *Caenorhabditis elegans*.

Yasuji Sakube et al., An Abnormal ketamine Response in Mutants Defective in the Ryanodine Receptor Gene *ryr*-1 (unc-68) of *Caenorhabditis elegans*, J. Mol. Biol., 267:849-864, 1997.

Elena Puente et al., Identification of a polymorphic ryanodine receptor gene from *Heliothis virescens* (Lepidoptera: Noctuidae), Insect Biochem. & Mol. Biol., vol. 30:335-347, 2000.

National Center for Biotechnology Information General Identifier No. 17352471, Accession No. 476994, Dec. 10, 2003, M. D. Adams et al., The genome sequence of *Drosophila melanogaster*.

Mark D. Adams et al., The Genome Sequence of *Drosophila melanogaster*, Science, vol. 287:2185-2195,, 2000.

National Center for Biotechnology Information General Identifier No. 21301556, Accession No. EAA71301, May 31, 2002, Unknown Author, Unknown Title.

National Center for Biotechnology Information General Identifier No. 1871447, Accession No. BAA08309, Dec. 25, 2002, Y. Sakube et al., An abnormal ketamine response in mutants defective in the ryanodine receptor gene ryr-1 (unc-68) of *Caenorhabditis elegans*.

National Center for Biotechnology Information General Identifier No. 18656155, Accession No. BAB84714, Feb. 14, 2002, M. Shiwa et al., Molecular cloning and characterization of ryanodine receptor from unfertilized sea urchin eggs.

National Center for Biotechnology Information General Indentifier No. 13569850, Accession No. NP076357, Dec. 21, 2003, H. Masumiya et al., The mouse sino-atrial node expresses both the type 2 and type 3 Ca(2+) release channels/ryanodine receptors.

Haruko Masumiya et al., The mouse sino-atrial node expresses both the type 2 and type 3 Ca(2+) release channels/ryanodine receptors, FEBS Letters, vol. 553:141-144, 2003.

Patrick Most et al., Transgenic Overexpression of the Ca2+-binding Protein S100A1 in the Heart Leads to Increased in Vivo Myocardial Contractile Performance, J. of Biol. Chem., vol. 278(36):33809-33817, 2003.

Huang-Tian Yang et al., The ryanodine receptor modulates the spontaneous beating rate of cardiomyocytes during development, PNAS, vol. 99(14):9225-9230, 2002.

Anne-Valerie Faure et al., Developmental expression of the calcium release channels during early neurogenesis of the mouse cerebral cortex, European J. of Neuroscience, vol. 14:1613-1622, 2001.

Mingcai Zhao et al., Molecular Identification of the Ryanodine Receptor Pore-forming Segment, J. of Biol. Chem., vol. 274(37):25971-25974, 1999.

Hiroshi Takeshima et al., Embryonic lethality and abnormal cardiac myocytes in mice lacking ryanodine receptor type 2, The EMBO J., vol. 17(12):3309-3316, 1998.

National Center for Biotechnology Information General Identifer No. 1245376, Accession No. AAA93465, Apr. 2, 1996, J. Nakai et al., Primary structure and functional expression from cDNA of the cardiac ryanodine receptor/calcium release channel.

Junichi Nakai et al., Primary structure and functional expression from cDNA of the cardiac ryanodine receptor/calcium release channel, FEBS vol. 271(1,2):167-177, 1990.

National Center for Biotechnology Information General Identifier No. 4506757, Accession No. NP001026, Dec. 23, 2003, C.H. George et al., Ryanodine receptor mutations associated with stress-induced ventricular tachycardia mediate increased calcium release in stimulated cardiomyocytes.

Christopher H. George et al., Ryanodine receptor mutations associated with stress-induced ventricular tachycardia mediate increased calcium release in stimulated cardiomyocytes, J. of Biol. Chem., vol. 278(31):28856-28864, 2003.

Jing Zhang et al., Three-dimensional Localization of Divergent Region 3 of the Ryanodine Receptor to the Clamp-shaped Structures Adjacent to the FKBP Binding Sites, J. Biol. Chem., vol. 278(16):14211-14218, 2003.

Haruko Masumiya et al., Localization of the 12.6-kDa FK506-binding Protein (FKBP12.6) Binding Site to the NH2-terminal Domain of the Cardiac Ca2+ Release Channel (Ryanodine Receptor), J. Biol. Chem., vol. 278(6):3786-3792, 2003.

Jiefei Tong et al., Caffeine and Halothane Sensitivity of Intracellular Ca2+ Release is Altered by 15 Calcium Release Channel (Ryanodine Receptor) Mutations Associated with Malignant Hyperthermia and/or Central Core Disease, J. Biol. Chem., vol. 272(42):26332-26339, 1997.

S. R. Wayne Chen et al., Antibodies as Probes for Ca2+ Activation Sites in the Ca2+ Release Channel (Ryanodine Receptor) of Rabbit Skeletal Muscle Sarcoplasmic Reticulum, J. Biol. Chem., vol. 268(18):13414-1421, 1993.

Celetta Callaway et al., Localization of the High and Low Affinity [3H]Ryanodine binding Sites on the Skeletal Muscle Ca2+ Release Channel, J. Biol. Chem., vol. 269(22):15876-15884, 1994.

Melanie Schmitt et al., Binding Sites for Ca2+-Channel Effectors and Ryanodine in Periplaneta americana—Possible Targets for New Insecticides, Pestic Science, vol. 48:375-385, 1996.

Richard E.A. Tunwell et al., The human cardiac muscle ryanodine receptor-calcium release channel: identification, primary structure and topological analysis, Biochem. J. vol. 318:477-487, 1996.

\* cited by examiner

FIGURE 1A

```
SEQ ID NO:2     MAEAEGGAS-EQDDVSILRTEDMVCMSCTATG--------ERVCLAAAEGLGNRHCFLENIAD-KNIPPDLSQCVFVIEQALSVRALQELV
SEQ ID NO:128   MAEAEGGAS-EQDDVSFLRTEDMVCLSCTATG--------ERVCLAAAEGFGNRHCFLENIAD-KNIPPDLSQCVFVIEQALSVRALQELV
SEQ ID NO:130   MAEAEGGAS-EQDDVSFLRTEDMVCLSCTATG--------ERVCLAAAEGFGNRHCFLENIAD-KNIPPDLSQCVFVIEQALSVRALQELV
SEQ ID NO:144   MAEAEGGAS-EQDDVSFLRTEDMVCLSCTATG--------ERVCLAAAEGFGNRHCFLENIAD-KNIPPDLSQCVFVIEQALSVRALQELV
SEQ ID NO:146   MAEAEGGAS-EQDDVSFLRTEDMVCLSCTATG--------ERVCLAAAEGFGNRHCFLENIAD-KNIPPDLSQCVFVIEQALSVRALQELV
SEQ ID NO:4     MADSEGSS--EQDDVSFLRTEDMVCLSCTATG--------ERVCLAAAEGFGNRHCYLENIAD-KNIPPDLSQCVFVIEQALSVRALQELV
SEQ ID NO:6     MADSEGSS--EQDDVSFLRTEDMVCLSCTATG--------ERVCLAAAEGFGNRHCYLENIAD-KNIPPDLSQCVFVIEQALSVRALQELV
SEQ ID NO:8     MADSEGGS--EQDDVSFLRTEDMVCLSCTATG--------ERVCLAAAEGFGNRHCFLENIAD-KNIPPDLSTCVFVIEQALSVRALQELV
SEQ ID NO:10    MAEAEGGS--EQDDVSFLRTEDMVTLSCTATG--------ERVCLAAAEGFGNRHCFLENIAD-KNVPPDLSQCVFVIEQALSVRALQELV
SEQ ID NO:56    MAEAEGGS--EQDDVSFLRTEDMVTLSCTATG--------ERVCLAAAEGFGNRHCFLENIAD-KNVPPDLSQCVFVIEQALSVRALQELV
SEQ ID NO:57    ---------------DMVCLSCTATG--------------ERVCLAAAEGFGNRHCFLENIAD-KNIPPDLSQCVFVIEQALSVRALQEMM
SEQ ID NO:58    MADKEEQGGGEQDDVSFLRTGDIVCLSCVASHNRDGVLGSERVCLCTEGFGNRMCTLENVSD-KDIPPDIAMCMLYIDNALSMRALQEMM
SEQ ID NO:59    -MASQDAE----DEVSFLRTGDQLNLVCSS---QS-----LGHVLLGAEGFGNRNCVLEEASN-QNVPPDLSICVFVLNQALSVRALQEMV
SEQ ID NO:60    MADAGEGE----DEIQFLRTDDEVVLQCTATIHKE-----QQKLCLAAAEGFGNRLCFLESTSNSKNVPPDLSICTFVLEQSLSVRALQEML
SEQ ID NO:61    MADGGEGE----DEIQFLRTDDEVVLQCTATIHKE-----QQKLCLAAAEGFGNRLCFLESTSNSKNVPPDLSICTFVLEQSLSVRALQEML
SEQ ID NO:62    MADGGEGE----DEIQFLRTDDEVVLQCTATIHKE-----QQKLCLAAAEGFGNRLCFLESTSNSKNVPPDLSICTFVLEQSLSVRALQEML

SEQ ID NO:2     TAAGSETGKE--------NLGKGTGSGYRTLLYGNAILLRHLNSDMYLACLSTS-SSQDKLAFDVGLQQHSQGEACWWTLHPASKQRSEG
SEQ ID NO:128   TAAGSETG----------KGTGSGHRTLLYGNAILLRHLNSDMYLACLSTS----SSQDKLAFDVGLQQHSQGEACWWTLHPASKQRSEG
SEQ ID NO:130   TAAGSETG----------KGTGSGHRTLLYGNAILLRHLNSDMYLACLSTS----SSQDKPAFDVGLQQHSQGEACWWTLHPASKQRSEG
SEQ ID NO:144   TAAGSETGKE--------NLGKGTGSGHRTLLYGNAILLRHLNSDMYLACLSTS-SSQDKLAFDVGLQQHSQGEACWWTLHPASKQRSEG
SEQ ID NO:146   TAAGSETGKE--------NLGKGTGSGHRTLLYGNAILLRHLNSDMYLACLSTS-SSQDKLAFDVGLQQHSQGEACWWTLHPASKQRSEG
SEQ ID NO:4     TAASSQEG----------KGGTGSGHRTLLYGNAILLRHQNSDMYLACLSTS---SSNDKLSFDVGLQEHSQGEACWWTVHPASNQRSEG
SEQ ID NO:6     TATSSQEG----------KGGTGSGHRTLLYGNAILLRHQNSDMYLACLSTS---SSNDKLSFDVGLQEHSQGEACWWTVHPASKQRSEG
SEQ ID NO:8     TAAGSEEG----------KG-TGSGHRTLLYGNAILLRHQNSDMYLACSSTS---SSNDKLSFDVGLQEHSQGEACWWTVHPASKQRSEG
SEQ ID NO:10    TAAGSETG----------KGTGSGHRTLLYGNAILLRHRHNSDMYLACLSTS---SSNDKLSFDVGLQEHSQGEACWWTVHPASKQRSEG
SEQ ID NO:56    TAAGSETG----------KGTGSGHRTLLYGNAILLRHHNNSDMYLACLSTS---SSNDKLSFDVGLQEHSQGEACWWTVHPASKQRSEG
SEQ ID NO:57    TAAGSETG----------KGTGSGHRTLLYGNAILLRHNNSDMYLACLSTS----SSNDKLSFDVGVQETNEGEACWWTIHPASKQRSEG
SEQ ID NO:58    SADSDHKS----------ASGAGGHKTLLYGHAVQLKHVQSEMYLACLSSC----SSNDKLAFDVGVQEMYLACLSSC--
SEQ ID NO:59    ITDQIDQGGQ--------AGHRTLLYGHAMLLQHSLSSMHLACLPTS--------SSKDKLAFDVGLQESTQGEACWWTIHPVSKQRSEG
SEQ ID NO:60    ANTVEKSEGQVDVEKWKFMKTAQGGHRTLLYGHAILLRHSYSGMYLCCLSTSRSSTDKLAFDVGLQEDTTGEACWWTIHPASKQRSEG
SEQ ID NO:61    ANTVEKSEGQVDVEKWKFMKTAQGGHRTLLYGHAILLRHSYSGMYLCCLSTSRSSTDKLAFDVGLQEDTTGEACWWTIHPASKQRSEG
SEQ ID NO:62    ANTVEKSEGQVDVEKWKFMKTAQGGHRTLLYGHAILLRHSYSGMYLCCLSTSRSSTDKLAFDVGLQEDTTGEACWWTIHPASKQRSEG
```

FIGURE 1B

```
SEQ ID NO:2    EKVRVGDDLILVSVAIERYLHTTKE--NEVSIVNASFHVTHWSVQPYGTG------------ISRMKYVGYVFGGDVLRFFHG-GDECLTI
SEQ ID NO:128  EKVRVGDDLILVSVATERYLHTTKE--NEVSIVNASFHVTHWSVQPYGTG------------ISRMKYVGYVFGGDVLRFFHG-GDECLTI
SEQ ID NO:130  EKVRVGDDLILVSVATERYLHTTKE--NEVSIVNASFHVTHWSVQPYGTG------------ISRMKYVGYVFGGDVLRFFHG-GDECLTI
SEQ ID NO:144  EKVRVGDDLILVSVATERYLHTTKE--NEVSIVNASFHVTHWSVQPYGTG------------ISRMKYVGYVFGGDVLRFFHG-GDECLTI
SEQ ID NO:146  EKVRVGDDLILVSVATERYLHTTKE--NEVSIVNASFHVTHWSVQPYGTG------------ISRMKYVGYVFGGDVLRFFHG-GDECLTI
SEQ ID NO:4    EKVPVGDDLILVSVATERYLHTAKE--NELSVVNASFHVTHWSVQPYGTG------------ISRMKYVGYVFGGDVLRFFHG-GDECLTI
SEQ ID NO:6    EKVRVGDDLILVSVATERYLHTAKE--NELSVVNASFHVTHWSVQPYGTG------------ISRMKYVGYVFGGDVLRFFHG-GDECLTI
SEQ ID NO:8    EKVRVGDDLILVSVATERYLHTTKE--NDLSIVNASFHVTHWSVQPYGTG------------ISRMKYVGYVFGGDVLRFFHG-GDECLTI
SEQ ID NO:10   EKVRVGDGLIPVSVATERYLHTTKE--NEQSIVNASFHVTHWSVQPYGTG------------ISRMKYVGYVFGGDVLRFFHG-GDECLTI
SEQ ID NO:56   EKVRVGDDLILVSVATERYLHTTKE--NEQSIVNASFHVTHWSVQPYGTG------------ISRMKYVGYVFGGDVLRFFHG-GDECLTI
SEQ ID NO:57   EKVRVGDDLILVSVATERYLHTTKE--NDLSIVNASFHVTHWSVQPYGTG------------ISRMKYVGYVFGGDVLRFFHG-GDECLTI
SEQ ID NO:58   EKVRVGDDVILVSVATERYLHMAYS---KGYMVIASFHQTLWNIQSVSSG------------SMRTRNMGFLFGNDVLRLFHG-NDECLTI
SEQ ID NO:59   EKVRVGDDLILVNVATERYLHLSVERDDQPMIVVASFQQTLWTVAPVSSGIVKIKAMAKKYGDTEKVLGFLNGLDTLRFSRGHMDEYLTV
SEQ ID NO:60   EKVRVGDDLILVSVSSERYLHLSYG--NSSWHVDAAFQQTLWSVAPISS-------------GSEAAQGYLIGGDVLRLLHGHMDECLTV
SEQ ID NO:61   EKVRVGDDLILVSVSSERYLHLSYG--NGSLHVDAAFQQTLWSVAPISS-------------GSEAAQGYLIGGDVLRLLHGHMDECLTV
SEQ ID NO:62   EKVRVGDDLILVSVSSERYLHLSYG--NGSLHVDAAFQQTLWSVAPISS-------------GSEAAQGYLIGGDVLRLLHGHMDECLTV

SEQ ID NO:2    P-STWTKDGGQNIVVYKGGSSVMSQARSLWRLELARTKWAGGFINWYHPMRIRHITTGRYLGVNDQNELYLVSREEPTTASCAFCLRQEKD
SEQ ID NO:128  P-STWTKDGGQNIVVYEGGSSVMSQARSLWRLELARTKWAGGFINWYHPMRIRHITTGRYLGVNDQNELYLVSREEATTASCAFCLRQEKD
SEQ ID NO:130  P-STWTKDGGQNIVVYEGGSSVMSQARSLWRLELARTKWAGGFINWYHPMRIRHITTGRYLGVNDQNELYLVSREEATTASCAFCLRQEKD
SEQ ID NO:144  P-STWTKDGGQNIVVYEGGSSVMSQARSLWRLELARTKWAGGFINWYHPMRIRHITTGRYLGVNDQNELYLVSREEATTASCAFCLRQEKD
SEQ ID NO:146  P-STWTKDGGQNIVVYEGGSSVMSQARSLWRLELARTKWAGGFINWYHPMRIRHITTGRYLGVNDQNELYLVSREEATTASCAFCLRQEKG
SEQ ID NO:4    P-SSWSNVSGQNIVIYEGGSSVMSQARSLWRLELARTKWAGGFINWYHPMRIRHLTTGRYLGVNENNELHLVCREEATTASSTFFLRQEKD
SEQ ID NO:6    P-STWSNVSGQNIVIYEGGSSVMSQARSLWRLELARTKWAGGFINWYHPMRIRHLTTGRYLGVNENNELHLVCREEATTASSTFFLRQEKD
SEQ ID NO:8    P-STWSEAPGQNIVIYEGGSVMSQARSLWRLELARTKWAGGFINWYHPMRIRHLTTGRYLGVNDSNELILVKKEEASIATTTFCLRQEKD
SEQ ID NO:10   P-STWGREAGQNIVIYEGGVVMAQARSLWRLELARTKWAGGFINWYHPMRIRHLTTGRYLGVNDSNELILVKKEEASIATTTFCLRQEKD
SEQ ID NO:56   P-STWGREAGQNIVIYEGGVVMAQARSLWRLELARTKWAGGFINWYHPMRIRHLTTGRYLGVNDSNELILMSRDQATTSQTAFVLRLEKD
SEQ ID NO:57   P-STWSLDSGQNIVIYEGGSSVMSQARSLWRVELIRMKWHGALVGWEQVFRIKHITSGRYLGVNENNELILMSRDQATTSQTAFVLRLEKD
SEQ ID NO:58   P-ENWSEHPQHNMVIYEGGAAVTQARSLWRAELILKKWNGSYVSWGPPCRIRHLTSGKYLAVLENGTVCIVPRKSCNLDDTIFCFQQSRE
SEQ ID NO:59   PPVGCKDDDNISEVSYDTGAVAQYARSLWRLETLRVAWSGSHIRWGQPFRLRHVTTGKYLSLMEDKNLLLMDKEKADVKSTAFAFRSSKE
SEQ ID NO:60   P-SGEHGEEQRRTVHYEGGAVSVHARSLWRLETLRVAWSGSHIRWGQPFRLRHVTTGKYLSLMEDKNLLLMDKEKADVKSTAFTFRSSKE
SEQ ID NO:61   P-SGEHGEEQRRTVHYEGGAVSVHARSLWRLETLRVAWSGSHIRWGQPFRLRHVTTGKYLSLMEDKNLLLMDKEKADVKSTAFTFRSSKE
SEQ ID NO:62   P-SGEHGEEQRRTVHYEGGAVSVHARSLWRLETLRVAWSGSHIRWGQPFRLRHVTTGKYLSLMEDKNLLLMDKEKADVKSTAFTFRSSKE
```

FIGURE 1C

| | |
|---|---|
| SEQ ID NO:2 | DQKQVLEDKDLEVIGAPIIKYGDSTVIVQHSETGLWLSYKSYETKKKGVGKVEEKQAILHEEGKMDDGLDLSRSQEEESMTARVIRKCSS |
| SEQ ID NO:128 | DQKQVLEDKDLEVIGAPIIKYGDSTVIVQHSETGLWLSYKSYETKKKGVGKVEEKQAILHEEGKMDDGLDFSRSQEEESRTARVIRKCSS |
| SEQ ID NO:130 | DQKQVLEDKDLEVIGAPIIKYGDSTVIVQHSETGLWLSYKSYETKKEGVGKVEEKQAILHEEGKMDDGLDFSRSQEEESRTARVIRKCSS |
| SEQ ID NO:144 | DQKQVLEDKDLEVIGAPIIKYGDSTVIVQHSETGLWLSYKSYETKKKGVGKVEEKQAILHEEGKMDDGLDFSRSQEEESRTARVIRKCSS |
| SEQ ID NO:146 | DQKQVLEDKDLEVIGAPIIKYGDSTVIVQHSETGLWLSYKSYETKKKGVGKVEEKQAILHEEGKMDDGLDFSRSQEEESRTARVIRKCSS |
| SEQ ID NO:4 | DQKIILEDKDLEVIGAPIIKYGDSTVLVQHSDTGLWLTYKSYETKKKGVGKVEEKQAVLHEEGKMDDGLDFSRSQEEESRTARVIRKCSS |
| SEQ ID NO:6 | DQKIILEDKDLEVIGAPIIKYGDSTVLVQHSDTGLWLTYKSYETKKKGVGKVEEKQAVLHEEGKMDDGLDFSRSQEEESRTARVIRKCSS |
| SEQ ID NO:8 | DQKVLEDKDLEVIGAPIIKYGDSTVLVQHSETGLWLTYKSYETKKKGVGKVEEKQAVLHEEGKMDDGLDFSRSQEEESRTARVIRKCSS |
| SEQ ID NO:10 | DEKKVLEDKDLEVIGSPIIKYGDTTVIVQHCETSLWLSYKSYETKKKGVGKVEEKQAILHEEGKMDDCLDFSRSQEEESKTARVIRKCSS |
| SEQ ID NO:56 | DEKKVLEDKDLEVIGSPIIKYGDTTVIVQHCETSLWLSYKSYETKKKGVGKVEEKQAILHEEGKMDDCLDFSRSQEEESRTARVIRKCSS |
| SEQ ID NO:57 | DQKVLEDKDLEIIGAPIIKYGDSTVIMQHYESGLWVSYKSYETKKKGVGKVEEKQAILHEEGKMDDGLDFSRSQEEESRTARVIRKCSS |
| SEQ ID NO:58 | PKKQMLDEKEEGMGNATIRYGETNAFIQHVKTQLWLSYQTTEVTKKGLGKVEEKKAVALKDGHMDDCYTFFMALEEESKSARVIRKCSS |
| SEQ ID NO:59 | D-LANYDSKQDHGMGSADIKYGDSTVLIQHMKTGHWLSYLVVES-VVGGRAAERK-VVMLPEGHMDDGFSVVRARAEESRSAGIIRKSTL |
| SEQ ID NO:60 | K-LDVGVRKEVDGMGTSEIKYGDSICYIQHVDTGLWLTYQAVDVKSARMGSIQRK-AIMHHEGHMDDGLNLSRSQHEESRTARVIRSTVF |
| SEQ ID NO:61 | K-LDGGVRKEVDGMGTSEIKYGDSICYIQHVDTGLWLTYQSVDVKSVRMGSIQRK-AIMHHEGHMDDGLNLSRSQHEESRTARVIRSTVF |
| SEQ ID NO:62 | K-LDVGVRKEVDGMGTSEIKYGDSVCYIQHVDTGLWLTYQSVDVKSVRMGSIQRK-AIMHHEGHMDDGISLSRSQHEESRTARVIRSTVF |

| | |
|---|---|
| SEQ ID NO:2 | LFTKFINGLETLQ-ENRRHSMFFASVNLGEMVMCLEDLTNYFAQPDEDMEHEEKQNKFRALRNRQDLFQEEGILNLILEAIDKINVVTSQ |
| SEQ ID NO:128 | LFTKFINGLETLQ-ENRRHSMFFASVNLGEMVMCLEDLINYFAQPDEDMEHEEKQNKFRALRNRQDLFQEEGILNLILEAIDKINVITSQ |
| SEQ ID NO:130 | LFTKFINGLETLQ-ENRRHSMFFASVNLGEMVMCLEDLINYFAQPDEDMEHEEKQNKFRALRNRQDLFQEEGILNLILEAIDKINVITSQ |
| SEQ ID NO:144 | LFTKFINGLETLQ-ENRRHSMFFASVNLGEMVMCLEDLINYFAQPDEDMEHEEKQNKFRALRNRQDLFQEEGILNLILEAIVKINVITSQ |
| SEQ ID NO:146 | LFTKFINGLETLQ-ENRRHSMFFASVNLGEMVMCLEDLINYFAQPDEDMEHEEKQNKFRALRNRQDLFQEEGILNLILEAIDKINVITSQ |
| SEQ ID NO:4 | LFTQFISGLENLQ-SNRRSSLFCSFVNLNEMVMCLEDLINYFAQPEEDMEHEEKQNRFRALRNRQDLFQEEGILNLILEAIDKVNIITSQ |
| SEQ ID NO:6 | LFTQFISGLENLQ-SNRRSSLFCSFVNLNEMVMCLEDLINYFAQPEEDMEHEEKQNRFRALRNRQDLFQEEGILNLILEAIDKVNIITSQ |
| SEQ ID NO:8 | LFTQFIRGLETLQ-VNRRHSLFCATVNLNEMVMCLEDLINYFAQPADDMEHEEKQNRFRALRNRQDLFQEEGILNLILEAIDKVNIITSQ |
| SEQ ID NO:10 | LFTQFITALETLQ-SNRRHSIFFQKVNLNEMVMCLEDLINYFSQPEDDMEHEEKQNRFRALRNRQDLFQEEGVLNLILEAIDKINIITSQ |
| SEQ ID NO:56 | LFTQFITALETLQ-SNRRHSIFFQKVNLNEMVMCLEDLINYFSQPEDDMEHEEKQNRFRALRNRQDLFQEEGVLNLILEAIDKINIITSQ |
| SEQ ID NO:57 | LFTKFISGLETLQ-ENRRHSIFLQTVNLGEMVMCLEDLINYFAQPEDDMEHEEKQNRLRALRNRQDLFQEEGVLNLILEAIDKINVISSQ |
| SEQ ID NO:58 | VLNKFLKGIDALQLE-GNQSTDWTRVDLNEVLKLMEDLIEYFAQPNDEQDFEEKQNHLRALRSRQDLFHEEGMVKLVLETIDKLSIFKSG |
| SEQ ID NO:59 | LFNQFFDALDSLRGEKEDDQLAWNSFNLSSVVDILEDLIEYFGEPEEDEDHEEKQKKLKALRNRQDLFHEEGMVKLVLETIDKLSIFKSG |
| SEQ ID NO:60 | LFNRFIRGLDALS---KKVKLPTIDLPIESVSLSLQDLIGYFHPPDEHLEHEDKQNRLRALKNRQNLFQEEGMINLVLECIDRLHVYSSA |
| SEQ ID NO:61 | LFNRFIRGLDALS---KKAKASSVDLPIESVSLSLQDLIGYFHPPDEHLEHEDKQNRLRALKNRQNLFQEEGMINLVLECIDRLHVYSSA |
| SEQ ID NO:62 | LFNRFIRGLDALS---KKAKASTVDLPIESVSLSLQDLIGYFHPPDEHLEHEDKQNRLRALKNRQNLFQEEGMINLVLECIDRLHVYSSA |

FIGURE 1D

```
SEQ ID NO:2    GFLAGFLAGDESGQSWEMISGYLYQLLAAIIKGNHTNCAQFANSNRFNWLFSRLGSQASGEGTGMLDVLHCILIDSPEALNMMRDEHIKV
SEQ ID NO:128  GFLAGFLAGDESGQSWEMISGYLYQLLAAIIKGNHTNCAQFANSNRLNWLFSRLGSQASGEGTGMLDVLHCVLIDSPEALNMMRDEHIKV
SEQ ID NO:130  GFLAGFLAGDESGQSWEMISGYLYQLLAAIIKGNHTNCAQFANSNRLNWLFSRLGSQASGEGTGMLDVLHCVLIDSPEALNMMRDEHIKV
SEQ ID NO:144  GFLAGFLAGDESGQSWEMISGYLYQLLAAIIKGNHTNCAQFANSNRLNWLFSRLGSQASGEGTGMLDVLHCVLIDSPEALNMMRDEHIKV
SEQ ID NO:146  GFLAGFLAGDESGQSWEMISGYLYQLLAAIIKGNHTNCAQFANSNRLNWLFSRLGSQASGEGTGMLDVLHCVLIDSPEALNMMRDEHIKV
SEQ ID NO:4    GFMVS-LAGDESGQSWDVISGYLYQLLAAIIKGNHTNCAQFANSNRLNWLFSRLGSQASSEGTGMLDVLHCVLIDSPEALNMMKDEHIKV
SEQ ID NO:6    GFMVS-LAGDESGQSWDVISGYLYQLLAAIIKGNHTNCAQFANTNRLNWLFSRLGSQASSEGTGMLDVLHCVLIDSPEALNMMKDEHIKV
SEQ ID NO:8    GFLVS-LAGDESGQSWDIISGYLISTYLYQLLAAIIKGNHTNCAQFANSNRLNWLFSRLGSQASSEGTGMLDVLHCVLIDSPEALNMMRDEHIKV
SEQ ID NO:10   GFLASFLAGDETGQSWDLISTYLYQLLAAIIKGNHTNCAQFANSNRLNWLFSRLGSQASSEGSGMLDVLHCVLIDSPEALNMMRDEHIKV
SEQ ID NO:56   GFLASFLAGDETGQSWDLISTYLYQLLAAIIKGNHTNCAQFANSNRLNWLFSRLGSQASSEGSGMLDVLHCVLIDSPEALNMMRDEHIKV
SEQ ID NO:57   GFLASFLASDESGQSWDMISGYLYQLLAAIIKGNHTNCAQFANSNRLNWLFSRLGSQASSEGSGMLDVLHCVLIDSPEALNMMRDEHIKV
SEQ ID NO:58   PDFAG-LIGEETHVKWEQISTYLYLLVAAMIKGNHYNCAQFASAQRLDWLINRLESQQASKG--ILDVLYCVLTESPEALNMINEGHIRS
SEQ ID NO:59   RDFAA-IVGEDAGLWQDIVTYLYKLLAAMIRHNHNNCALFAQSVRLDWLINRLESQQASKG--VLEVLHCVLGSPEALNIIKENHIKS
SEQ ID NO:60   AHFAD-VAGREAGESWKSILNSLYELLAALIRGNRKNCAQFSG--SLDWLISRLERLEASSG--ILEVLHCVLVESPEALNIIKEGHIKS
SEQ ID NO:61   AHFAD-VAGREAGESWKSILNSLYELLAALIRGNRKNCAQFSG--SLDWLISRLERLEASSG--ILEVLHCVLVESPEALNIIKEGHIKS
SEQ ID NO:62   AHFAD-VAGREAGESWKSILNSLYELLAALIRGNRKNCAQFSG--SLDWLISRLERLEASSG--ILEVLHCVLVESPEALNIIKEGHIKS

SEQ ID NO:2    IISLLEKHGRDPKVLDVLCSLCVGNGVAVRSSQNNICDYLLPGKNLLLQTALVDHVSSVRPNIFVGRVEGSAVYRKWYFEVTMDHIE-KT
SEQ ID NO:128  IISLLEKHGRDPKVLDVLCSLCVGNGVAVRSSQNNICDYLLPGKNLLLQTALVDHVSSVRPNIFVGRVEGSAVYRKWYFEVTMDHIE-KT
SEQ ID NO:130  IISLLEKHGRDPKVLDVLCSLCVGNGVAVRSSQNNICDYLLPGKNLLLQTALVDHVSSVRPNIFVGRVEGSAVYRKWYFEVTMDHIE-KT
SEQ ID NO:144  IISLLEKHGRDPKVLDVLCSLCVGNGVAVRSSQNNICDYLLPGKNLLLQTALVDHVSSVRPNIFVGRVEGSAVYRKWYFEVTMDHIE-KT
SEQ ID NO:146  IISLLEKHGRDPKVLDVLCSLCVGNGVAVRSSQNNICDYLLPGKNLLLQTALVDHVSSVRPNIFVGRVEGSAVYRKWYFEVTMDHIE-KT
SEQ ID NO:4    IISLLEKHGRDPKVLDVLCSLCVGNGVAVRSSQNNICDFLLQGKNLLLPGKNLLLQTLLVDHVASVRPNIFVGHVSGSAVYRKWYYEVAIDHVE-QT
SEQ ID NO:6    IISLLEKHGRDPKVLDVLCSLCVGNGVAVRSSQNNICDFLLPGKNLLLQTLLVDHVASVRPNIFVGHVSGSAVYRKWYYEVAIDHVE-QT
SEQ ID NO:8    IISLLEKHGRDPKVLDVLCSLCVGNGVAVRSSQNNICDFLLPGKNLLLPQTQLVDHVSGSAVYQKWYYEVAIDHVE-QT
SEQ ID NO:10   VISLLEKHGRDPKVLDVLCSLCVGNGVAVRSSQNNICDFLLPGKNLLLQTLLVDHVASIRPNIFVGRVDGSSMYQKWYFEVTMDHIE-QT
SEQ ID NO:56   IISLLEKHGRDPKVLDVLCSLCVGNGVAVRSSQNNICDFLLPGKNLLLQTLLVDHVASIRPNIFVGRVDGSSMYQKWYFEVTMDHIE-QT
SEQ ID NO:57   VISLLEKHGRDPKVLDVLCSLCEGNGMAVRSSQNLITQYLLPGKDLLLPSRDLLPGRDLLLQTAVVDEVVCMRPNVSISVDKNSTVKKWYFEAEVEHIE-TM
SEQ ID NO:58   MISQLEKHGRNHKVLDVLCSLCVCHGVAVRSNQHLICDNLLPGRDLLPGRDLLLQTRLVNHVSSMRPNIFLGVSEGSAQYKKWYYELMVDHTEPFV
SEQ ID NO:59   IISLLDKHGRNHKVLDVLCSLCVCHGVAVRSNQHLICDNLLPGRDLLPGRDLLLQTRLVNHVSSMRPNIFLGVSEGSAQYKKWYYELMVDHTEPFV
SEQ ID NO:60   IISLLDKHGRNHKVLDVLCSLCVCHGVAVRSNQHLICDNLLPGRDLLPGRDLLLQTRLVNHVSSMRPNIFLGVSEGSAQYKKWYYELMVDHTEPFV
SEQ ID NO:61   IISLLDKHGRNHKVLDVLCSLCVCHGVAVRSNQHLICDNLLPGRDLLPGRDLLLQTRLVNHVSSMRPNIFLGVSEGSAQYKKWYYELMVDHTEPFV
SEQ ID NO:62   IISLLDKHGRNHKVLDVLCSLCVCHGVAVRSNQHLICDNLLPGRDLLPGRDLLLQTRLVNHVSSMRPNIFLGVSEGSAQYKKWYYELMVDHTEPFV
```

FIGURE 1E

```
SEQ ID NO:2    THMMPHLRIGWANTTGYVPYPGGGEKWGGNGVGDDLYSYGFDGAYLWSGGRKTPVNRTHAEEPYIRKGDVIGCALDLTVPIINFMFNGVR
SEQ ID NO:128  THMMPHLRIGWANTTGYVPYPGGGEKWGGNGVGDDLYSYGFDGAYLWSGGRKTPVNRTHAEEPYIRKGDVIGCALDLTVPIINFMFNGVR
SEQ ID NO:130  THMIPHLRIGWANTTGYVPYPGGGEKWGGNGVGDDLYSYGFDGAYLWSGGRKTPVNRTHAEEPYIRKGDVIGCALDLTVPIINFMFNGVR
SEQ ID NO:144  THMMPHLRIGWANTTGYVPYPGGGEKWGGNGVGDDLYSYGFDGAYLWSGGRKTPVNRTHAEEPYIRKGDVIGCALDLTVPIINFMFNGVR
SEQ ID NO:146  THMMPHLRIGWANTAGYVPYPGGGEKWGGNGVGDDLYSYGLDGAYLWSGGRKTPVNRTHAEEPYIRKGDVIGCALDLTVPIINFMFNGVR
SEQ ID NO:4    THLNPHIRIGWANTAGYVPYPGGGEKWGGNGVGDNLYSFGFDGSYLWTGGRKSGVMPGT-QISNIKKSDVIGCALDLTIPIITFTLNGQL
SEQ ID NO:6    THLNPHIRIGWANTAGYVPYPGGGEKWGGNGVGDDLYSFGFDGSYLWTGGRKSEVMPGS-EISNIKKGDVIGCALDLTIPIITFTLNGQL
SEQ ID NO:8    THMTPHLRIGWANTSGYVPYPGGGEKWGGNGVGDDLYSYGFDGANLWTGGRKTCVLPHA-TEPFIKKGDVIGVSLDLTVPIITFSFNGSP
SEQ ID NO:10   THMMPHLRIGWANTSGYVPYPGGGKKWGGNGVGDDLYSFGFDGAFLWTGGRKTLVVDALPEEPFIRKGDVIGVAIDLSVPIITFTFNGVK
SEQ ID NO:56   THMMPHLRIGWANTSGYVPYPGGGKKWGGNGVGDDLYSFGFDGAFLWTGGRKTLVVDALPEEPFIRKGDVIGVAIDLSVPIITFTFNGVK
SEQ ID NO:57   THMTPHLRIGWANTAGYVPYPGGGEKWGGNGVGDDLFSYGFDGVYFWSAGRRTCVPREVTEPFIKKGDVIGCTLDLSVPVIRFTFNGEP
SEQ ID NO:58   TKQTPYLRIGWANSVGFKPFPGSGDKMGCNGVGDDFYSYGFDGKSMYFGGKSRRVG----HKLLEKGDVIGCSIDLTIPEIKFSVNGTY
SEQ ID NO:59   TSRPVHFRVGWATTQGFRTYLRGEGEGWGNSGVVDDLYSFGFDGLNLWTGGVSKAAPWSG-NRLLSKGDIVGVCFDLSVPRILYHVNGSP
SEQ ID NO:60   TAEATHLRVGWASTEGYSPYPGGGEEWGGNGVGDDLFSYGFDGLHLWSGCIARTVSSPN--QHLLRTDDVISCCLDLSAPSISFRINGQP
SEQ ID NO:61   TAEATHLRVGWASTEGYSPYPGGGEEWGGNGVGDDLFSYGFDGLHLWSGCIARTVSSPN--QHLLRTDDVISCCLDLSAPSISFRINGQP
SEQ ID NO:62   TAEATHLRVGWASTEGYSPYPGGGEEWGGNGVGDDLFSYGFDGLHLWSGCIARTVSSPN--QHLLRTDDVISCCLDLSAPSISFRINGQP

SEQ ID NO:2    VTGSFTNFNLEGMFFPVISCSSKLSCRFLLGGEHGRLRYAAPEGYSPLVESLLPQQILSLEP--CFYFGNLSKRALAGP-PLVQDDTAFV
SEQ ID NO:128  VTGSFTNFNLEGMFFPVISCSSKLSCRFLLGGEHGRLRYAAPEGYSPLVESLLPQQILSLEP--CFYFGNLSKRALAGP-PLVQDDTAFV
SEQ ID NO:130  VTGSFTNFNLEGMFFPVISCSSKLSCRFLLGGEHGRLRYAAPEGYSPLVESLLPQQILSLEP--CFYFGNLSKRALAGP-PLVQDDTAFV
SEQ ID NO:144  VTGSFTNFNLEGMFFPVISCSSKLSCRFLLGGEHGRLRHAAPEGYSPLVESLLPQQILSLEP--CFYFGNLSKRALAGP-PLVQDDTAFV
SEQ ID NO:146  VTGSFTNFNLEGMFFPVISCSSKVSCRFLLGGDHGRLKFTPPDEFSPLFETLLPQQILTIDP--CFYFGNLNKCVLTGP-WYVEDGTAFV
SEQ ID NO:4    VQGAFRDFNLDGMFFPVISCSSKVSCRFLLGGDHGRLKFTPPDEFSPLFESLLPQQILTIDP--CFYFGNLSKCVLTGP-WYVEDDTAFV
SEQ ID NO:6    VQGAFRDFNLDGMFFPVISCSSKVGCRFLLGGDHGRLKFTPPDEFSPLVPPEEFSPLVESLLPQQVLSIDP--CFYFGNLNKCVLSGP-WTVEDDTAFV
SEQ ID NO:8    IRGCFRDFNYDGMFFPVISCSHKLSCRFLFGGDHGRLKFAPPMGFSALVQCLMPQQILSLDP--CFYFGNLAKNVLAGP-WLIEDDTAFV
SEQ ID NO:10   VRGSFRDFNLDGMFFPVMSCSSKLSCRFLFGGDHGRLKFAPPMGFSALVQCLMPQQILSLDP--CFYFGNLAKNVLAGP-WLIEDDTAFV
SEQ ID NO:56   VRGSFRDFNLDGMFFPVMSCSSKLSCRFLFGGDNGRLKFNPPPGFSPLVQCLMPHQNLSLDP--CFYFGNLNKNVLAGP-WLVEDDSAFV
SEQ ID NO:57   VQGCFTDFNLDGMFFPVMSCSSKLSCRFILGGNQGRLRYGPPTGFSAVVEAVN--GELQITD--CLSFGDLGKNIFSGPQTIFNNLEPFI
SEQ ID NO:58   MSGSFKKFNIDGYFFPVMSLSAKVSCRFILGGKHGRFKYSPPKGFAAVCESVLPKERLKIEP--CFALGHVTEGIIQQP-TASQDHSAFI
SEQ ID NO:59   IKASFEGINLEGMFFPVLSFSARVCARFILGGKHGRFKFKYSPPKGFAAVCESVLPKERLKIEP--CFALGHVTEGIIQQP-TASQDHSAFI
SEQ ID NO:60   VQGMFENFNIDGLFFPVVSFSAGIKVRFLLGGRHGEFKFLPPPGYAPCYEAVLPKEKLKVEHSREYKQERTYTRDLLGP-TVSLTQAAFT
SEQ ID NO:61   VQGMFENFNIDGLFFPVVSFSAGIKVRFLLGGRHGEFKFLPPPGYAPCYEAVLPKEKLKVEHSREYKQERTYTRDLLGP-TVSLTQAAFT
SEQ ID NO:62   VQGMFENFNIDGLFFPVVSFSAGIKVRFLLGGRHGEFKFLPPPGYAPCYEAVLPKEKLKVEHSREYKQERTYTRDLLGP-TVSLTQAAFT
```

FIGURE 1F

```
SEQ ID NO:2    PTPVDTLQITLPTYVEQIRDKLAENIHEMWAMNKIEAGWMYGDQREDLHKIHPCLVPFERLPPAEKRYDIQLAVQTLKTILALGYYISLD
SEQ ID NO:128  PTPVDTLQITLPTYVEQIRDKLAENIHEMWAMNKIEAGWMYGDQREDLHKIHPCLVPFERLPPAEKRYDIQLAVQTLKTILALGYYISLD
SEQ ID NO:130  PTPVDTLQITLPTYVEQIRDKLAENIHEMWAMNKIEAGWMYGDQREDLHKIHPCLVPFERLPPAEKRYDIQLAVQTLKTILALGYYISLD
SEQ ID NO:144  PTPVDTLQITLPTYVEQIRDKLAENIHEMWAMNKIEAGWMYGDQREDLHKIHPCLVPFERLPPAEKRYDIQLAVQTLKTILALGYYISLD
SEQ ID NO:146  PTPVDTLQITLPTYVEQIRDKLAENIHEMWAMNKIEAGWMYGDQREDLHKIHPCLVPFERLPPAEKRYDIQLAVQTLKTILALGYYISLD
SEQ ID NO:4    PNPVDTSMVTLPSYIENIKDKLAENIHEMWAMNKIEAGWQYGDKRNDTRKYHPCLIQFDKLPPAEKRYDSQLAVQTLKTVIALGYHISID
SEQ ID NO:6    PNPVDTSMVTLPSYIENIKDKLAENIHEMWAMNKIEAGWQYGDKRNDTRKYHPCLIQFDKLPPAEKRYDSQLAVQTLKTVIALGYHISID
SEQ ID NO:8    PTPVDTTKVSLPNYIESIRDKLAENIHEMWAMNKIEAGWMFGEKRDDIRKVHPCLIQFDQLPPAEKRYDNQLAVQTLKTIISLGYYITMD
SEQ ID NO:10   PKPVDTGVTLPSSVDQIKEKLAENIHEMWALNKIEAGWSGEHRDDYHRIHPCLTHFEKLPAAEKRYDNQLAVQTLKTIISLGYYITMD
SEQ ID NO:56   PKPVDTGVTLPSSVDQIKEKLAENIHEMWALNKIEAGWSGEHRDDYHRIHPCLTHFEKLPAAEKRYDNQLAVQTLKTILALGYYITMD
SEQ ID NO:57   PKPVDTSIVTLPSSVETIKDKLAENIHEMWALNKIEAGWTWGERRDDVYRIHPCLTSFEKLPAAEKRYDCQLAVQTLKTILALGYYISMD
SEQ ID NO:58   PTPIDVSATQLNHHATEMHQKYAENLHELWAMRKIELGWSYGETRSETSRKHPCLTKFEYLPETEKKYNILLALTTMKTIEALGYHLITE
SEQ ID NO:59   PAPVDTANVNLPGYIEMLRDKLAENIHELWVMNKIEAGWTWGPVRDDSKKVHDSLMFFSSLSEQEKNFDITMAYETLRTLMALGYHISID
SEQ ID NO:60   PVPVDTSQIVLPPHLERIRERLAENIHELWVMNKIELGWQYGPVRDDNKRQHPCLVEFCKLPEQERNYNLQMSLETLKTLLALGCHVGIA
SEQ ID NO:61   PIPVDTSQIVLPPHLERIREKLAENIHELWVMNKIELGWQYGPVRDDNKRQHPCLVEFSKLPEQERNYNLQMSLETLKTLLALGCHVGIS
SEQ ID NO:62   PIPVDTSQIVLPPHLERIREKLAENIHELWVMNKIELGWQYGPVRDDNKRQHPCLVEFSKLPEQERNYNLQMSLETLKTLLALGCHVGIS

SEQ ID NO:2    KPPAR--IRNVRLPNEPFMQSNGYKPAPLDLSAVTLTPKMDELVGQLAENTHNLWARERIQQGWTYGLNE--DSDMHRSPHLVPYPKVDD
SEQ ID NO:128  KPPAR--IRNVRLPNEPFMQSNGYKPAPLDLSAVTLTPKMDELVDQLAENTHNLWARERIQQGWTYGLNE--DSDMHRSPHLVPYPKVDD
SEQ ID NO:130  KPPAR--IRNVRLPNEPFMQSNGYKPAPLDLSAVTLTPKMDELVDQLAENTHNLWARERIQQGWTYGLNE--DSDMHRSPHLVPYPKVDD
SEQ ID NO:144  KPPAR--IRNVRLPNEPFMQSNGYKPAPLDLGAVTLTPKMDELVDQLAENTHNLWARERIQQGWTYGLNE--DSDMHRSPHLVPYPKVDD
SEQ ID NO:146  KPPAR--IRNVRLPNEPFMQSNGYKPAPLDLSAIILSGKMEELIDQLAGNTHNLWAKERIQQGWTYGLNE--ELQMLRSPHLVPYSKVDD
SEQ ID NO:4    NPPSR--IKTVRLPNEPFMQSNGYKPAPLDLSAINLSGKMEELIDQLAENTHNLWAKERIQQGWTYGLNE--ELQMLRSPHLVPYSKVDD
SEQ ID NO:6    NPPSR--IKTVRLPNEPFMQSNGYKPAPLDLTAISLTPKMEELVDQLAENTHNLWAKERIQQGWTYGLNE--DSDMLRSPHLVPYCKVDE
SEQ ID NO:8    KPPSR--IKTIRLPNEPFMQGNGYKPAPLDLSAVTLTPKLEELVDQLAENTHNLWARERIQQGWTYGLNE--DSENHRSPHLVPYAKVDE
SEQ ID NO:10   KPPAR--IRPVRLPNEIFMQGNGYKPAPLDLSAVTLTPKLEELVDQLAENTHNLWARERIQQGWTYGLNE--DSENHRSPHLVPYAKVDE
SEQ ID NO:56   KPPAR--IRPVRLPNEIFMQGNGYKPAPLDLSAVTLGPKMEELVDQLAENTHNLWAKERIQQGWTYGLNE--DSENLRSPHLVPYSKVDE
SEQ ID NO:57   KPPAR--IRPIRLPNDPYMQGNGYKPAPLDLSAAVLTPKMEELVDQLPLTEALARNTHNIWAKEKIKRGWTFGLSEHVDATQKRSPHLVPYEQVDE
SEQ ID NO:58   DPPCR--LRAVRLGPN-FQQQNGYKPGPLDTHEIQLPAELQPLTEALARNTHNIWAKEKIKRGWTFGLSEHVDATQKRSPHLVPYEQVDE
SEQ ID NO:59   EETSKSTLKRLRLPMN-YLMSNGYKPAPYNLSTIHLNVKMEKLVELLAENAHNVWAKDRIAQGWTYGLSE-ETSYKRNPQLVPYNQLND
SEQ ID NO:60   DEHAEEKVKKMKLPKN-YQLTSGYKPAPMDLSFIKLTPSQEAMVDKLAENAHNVWARDRIRQGWTYGIQQ--DVKNRRNPRLVPYTLLDD
SEQ ID NO:61   DEHAEEKVKKMKLPKN-YQLTSGYKPAPMDLSFIKLTPSQEAMVDKLAENAHNVWARDRIRQGWTYGIQQ--DVKNRRNPRLVPYTLLDD
SEQ ID NO:62   DEHAEDKVKKMKLPKN-YQLTSGYKPAPMDLSFIKLTPSQEAMVDKLAENAHNVWARDRIRQGWTYGIQQ--DVKNRRNPRLVPTPLDD
```

FIGURE 1G

| SEQ ID NO: | Sequence |
|---|---|
| SEQ ID NO:2 | AIKKANRDTASETVRTLLVYGYMLDPPTGEQHEA-----LLLEASKQKQADFRTYRAEKNYAVSSGKWYFEFEILTAGPMRVGWAHADMAP |
| SEQ ID NO:128 | AIKKANRDTASETVRTLLVYGYMLDPPTGEQHEA-----LLLEASKQKQADFRTYRAEKNYAVSSGKWYFEFEILTAGPMRVGWAHADMAP |
| SEQ ID NO:130 | AIKKANRDTASETVRTLLVYGYMLDPPTGEQHEA-----LLLEASKQKQADFRTYRAEKNYAVSSGKWYFEFEILTAGPMRVGWAHADMAP |
| SEQ ID NO:144 | AIKKANRDTASETVRTLLVYGYMLDPPTGEQHEA-----LLLEASKQKQADFRTYRAEKNYAVSSGKWYFEFEILTAGPMRVGWAHADMAP |
| SEQ ID NO:146 | AIKKANRDTASETVRTLLVYGYMLDPPTGEQHEA-----LLLEASKQKQADFRTYRAEKNYAVSSGKWYFEFEILTAGPMRVGWAHADMAP |
| SEQ ID NO:4 | AIKKANRDTASETVRTLLVYGYNLDPPTGETNEAT---LLTDDNSNRYLTFRTYRAEKTYAVSSGKWYFEFEILTSGPMRVGWARFTCSP |
| SEQ ID NO:6 | AIKKANRDTASETVRTLLVYGYNLDPPTGETNEAT---LLTDENTNRYLTFRTYRAEKTYAVASGKWYFEFEILTNGPMRVGWARFTCSP |
| SEQ ID NO:8 | AIKKANRDTASETVRTLLVYGYNLDPPTGEAHEA----LLAEASRLRQTHFRTYRAEKNYAVTTGKWYFEFEILTAGPMRVGWARSDCPP |
| SEQ ID NO:10 | AIKKANRDTASETVRTLLVYGYVLDPPTGEGTEA----LLAEAQRLKFAGFRTYRVERNYAVTSGKWYFEFEVLTSGPMRVGWARADCYP |
| SEQ ID NO:56 | AIKKANRDTASETVRTLLVYGYVLDPPTGEGTEA----LLAEAQRLKFAGFRTYRVERNYAVTSGKWYFEFEVLTSGPMRVGWARADCYP |
| SEQ ID NO:57 | AIKKANRDTASETVRTLLIYGYNLDPPTGEANEA----LAAEALRQKFAAYRTYRVERTYAVTSGKWYFEFEVLTAGPMRVGWARADCNP |
| SEQ ID NO:58 | RIKQANRESAAENIRALQLFGIFLEPPAHEHDEV-----AEKELRARKDNTRTYRAEATYAVCGGIKWYFEFEILTAGYMKIGWMDIGSTP |
| SEQ ID NO:59 | QAKKLNRDTASETIRTILGFGYALEPPTNEGQSDPSFRGLAREISDKKSHTRTFRAEKSYAVKSGRWYFEFEAMTTGYMRVGWGRPTIAA |
| SEQ ID NO:60 | RTKKSNKDSLREAVRTLLGYGYHLEAPDQDHASR------AEVCSGTGERFRIFRAEKTYAVKAGRWYFEFEAVTAGDMRVGWSRPGCQP |
| SEQ ID NO:61 | RTKKSNKDSLREAVRTLLGYGYNLEAPDQDHAAR------AEVCSGTGERFRIFRAEKTYAVKAGRWYFEFEAVTSGDMRVGWSRPGCQP |
| SEQ ID NO:62 | RTKKSNKDSLREAVRTLLGYGYNLEAPDQDHAAR------AEVCSGTGERFRIFRAEKTYAVKAGRWYFEFETVTAGDMRVGWSRPGCQP |

| SEQ ID NO: | Sequence |
|---|---|
| SEQ ID NO:2 | GMMLGQDENSWAFDGYNEEKVYSGNTESFGKQWAVGDVVGFLDLIDKTISFSLNGELLMDALGGETTFADVQGDN--FVPACTLGVGQK |
| SEQ ID NO:128 | GMMLGQDENSWAFDGYNEEKVYSGNTESFGKQWAVGDVVGFLDLIDKTISFSLNGELLMDALGGETTFADVQGDN--FVPACTLGVGQK |
| SEQ ID NO:130 | GMMLGQDENSWAFDGYNEEKVYSGNTESFGKQWAVGDVVGFLDLIDKTISFSLNGELLMDALGGETTFADVQGDN--FVPACTLGVGQK |
| SEQ ID NO:144 | GMMLGQDENSWAFDGYNEEKVYSGNTESFGKQWAVGDVVGFLDLIDKTISFSLNGELLMDALGGETTFADVQGDN--FVPACTLGVGQK |
| SEQ ID NO:146 | GMMLGQDENSWAFDGYNEEKVYSGNTESFGKQWAVGDVVGFLDLIDKTISFSLNGELLMDALGGETTFADVQGDN--FVPACTLGVGQK |
| SEQ ID NO:4 | GYQIGSDENSWAFDGYNEEKIYMGTAESFGRQWQVGDVVGFLDLMDHTISFSMNGELLMDTLGGETTFSEVQGEG--FVPAFTLGLGQK |
| SEQ ID NO:6 | GYQIGSDENSWAFDGYNEEKIYMGTAESFGRQWQVGDVVGFLDLMDHTISFSLNGELLMDTLGGETTFSEVQGEG--FVPAFTLGLGQK |
| SEQ ID NO:8 | GSQLGNDEYSWAFDGFNEEKVYLGTGESFGRQWQVGDVVGFLDLLDHTMSFSLNGELLMDALGGETSFADVQGES--FVPAFTLGVGQK |
| SEQ ID NO:10 | GAMLGSEDTSWAFDGHNVTKMHAGSIEHFGVRYEAGDVIGCFIDVKEQTISFSLNGELLMDALGGETTFADVTAEGVGFVPACTLGVGQK |
| SEQ ID NO:56 | GAMLGSEDTSWAFDGHNEEKVYGGVSESFGKQCCGPDIVGVFLDLADHTISFSLNGELLMDALGGETTFADVTAEGVGFVPACTLGVGQK |
| SEQ ID NO:57 | GTMLGSDDASWAFDGYN-----------------------------------------------------------IGQK |
| SEQ ID NO:58 | EIQLGADDRSYAFDGYLGRKWHQG-AETYGKEWKIGDVVGCFLDLNDRTISFSLNGELLLDDPSGSEMAFDNVVCGDG-LVPAMTLGSGQR |
| SEQ ID NO:59 | RSEVGTDGCSFAFDGFLARKWHQGS-ETFGKTWGEMDVIGCMLNLVDNTISFTMNGEYLCDSVGSEMAFHDIEIGEG-FVPVCMLAAGEK |
| SEQ ID NO:60 | DLELGSDDRAFAFDGFKAQRWHQGN-EHYGRSWQAGDVVGCMVDMNEHTMMFTLNGEILLDDSGSELAFKDFDVGDG-FIPVCSLGVAQV |
| SEQ ID NO:61 | DQELGSDERAFAFDGFKAQRWHQGN-EHYGRSWQAGDVVGCMVDMNEHTMMFTLNGEILLDDSGSELAFKDFDVGDG-FIPVCSLGVAQV |
| SEQ ID NO:62 | DQELGSDERAFAFDGFKAQRWHQGN-EHYGRSWQAGDVVGCMVDMNEHTMMFTLNGEILLDDSGSELAFKDFDVGDG-FIPVCSLGVAQV |

FIGURE 1H

```
SEQ ID NO:2     ARLTYGQDVNTLKYFTTCGLQEGYEPFCVNMKRDVTHWYTKDQPIFENTDEMID-TRIDVTRIPAGSDTPPCLKISHNTFE----TMEKA
SEQ ID NO:128   ARLTYGQDVNTLKYFTTCGLQEGYEPFCVNMKRDVTHWYTKDQPIFENTDEMID-TRIDVTRIPAGSDTPPCLKISHNTFE----TMEKA
SEQ ID NO:130   ARLTYGQDVNTLKYFTTCGLQEGYEPFCVNMKRDVTHWYTKDQPIFENTDEMID-TRIDVTRIPAGSDTPPCLKISHNTFE----TMEKA
SEQ ID NO:144   ARLTYGQDVNTLKYFTTCGLQEGYEPFCVNMERDVTHWYTKDQPIFENTDEMID-TRIDVTRIPAGSDTPPCLKISHNTFE----TMEKA
SEQ ID NO:146   ARLTYGQDVNTLKYFTTCGLQEGYEPFCVNMKRDVTHWYTKDQPIFENTDDFS--SVIDVTRIPAGSDTPPCLKISHNTFE----TMEKA
SEQ ID NO:4     AKLTFGQDVNSLKYFTTCGLQEGYEPFCVNMKRPVAYWYTKDQPIFENTDDFS--SVIDVTRIPAGSDTPPCLKISHNTFE----TMERA
SEQ ID NO:6     AKLTFGQDVNSLKYFTVCGLQEGYEPFCVNMKRPVTYWYTKDQPIFENTEDYAD-SRIDVTRIPAGSDTPPCLKISHNLFE----SMEKA
SEQ ID NO:8     AKLTFGQDVTVLKFFTTCGLQEGYEPFCVNMNRAVTYWYTKDQPIFENTEEMPD-CRIDVTRIPGADTPPHLKISHNTFE----TMEKA
SEQ ID NO:10    ARLIYGQDVDSLKFFTTCGLQEGYEPFCVNMRRPVTHWYTKDQPIFENTEEMPD-CRIDVTRIPGGADTPPHLKISHNTFE----TMEKA
SEQ ID NO:56    ARLIYGQDVDSLKFFTTCGLQEGYEPFCVNMKRPVTHWYTKDQPIFENTDEIPE-CKIDVTRIPGGADTPPCMKISHNTFE----TMEKA
SEQ ID NO:57    ARVVYGQDVDSLKWFTTCGLQEGYEPFCVNMKRPVTHWYTKDQPIFENTDEIPE-CKIDVTRIPGAGDTPPCMKISHNTFE----TMEKA
SEQ ID NO:58    GRLNFGQQSNSLKFFTTCGLQEGYEPFCVNMYRTMPMWFAKHFPRFEDISTLKSGSILEVSRIPATGNSPPCLKILQKVTISEGGPSEKA
SEQ ID NO:59    AHLHFGQDVNDLKYFVCGLKYFTICGLQEGYEPFCVNMKKSMPLWYSKSQPMFQSIEDEH--DRLGITRIPAGIEGPPCLKVSHKKCG---TVENL
SEQ ID NO:60    GRMNFGKDVSTLKYFTICGLQEGYEPFCVNMKKSMPLWYSKSQPMFQSIEDEH--EHIEVTRIDGTIDSSPCLKVTQKSFGS---QNNNT
SEQ ID NO:61    GRMNFGKDVSTLKYFTICGLQEGYEPFCVNMKKSMPLWYSKSQPMFQSIEDEH--EHIEVTRIDGTIDSSPCLKVTQKSFGS---QNSNT
SEQ ID NO:62    GRMNFGKDVSTLKYFTICGLQEGYEPFCVNMKKSMPLWYSKSQPMFQSIEDEH--EHIEVTRIDGTIDSSPCLKVTQKSFGS---QNSNT

SEQ ID NO:2     NWEFLRLSLPVICHNEFIDEAEKARRWVEIKDRQRILMK-------EAVEAQMS------AHIDQIMRSGFTMNDIKGLHYE-DNQEE
SEQ ID NO:128   NWEFLRLSLPVICHNEFIDEAEKARRWVEIKDRQRILMK-------EAVEAQMP------AHIDQIMRSGFTMNDIKGLHYE-DNQEE
SEQ ID NO:130   NWEFLRLSLPVICHNEFIDEAEKARRWVEIKDRQQILMK-------EAVEAQMP------AHIDQIMRSGFTMNDIKGLHYE-DNQEE
SEQ ID NO:144   NWEFLRLSLPVICHNEFIDEAEKARRWVEIKDRQQILMK-------EAVEAQMP------AHIDQIMRSGFTMNDIKGLHYE-DNQEE
SEQ ID NO:146   NWEFLRLSLPVICHNEFIDEAEKARRWVEIKDRQQILMK-------EAVEAQMP------AHIDQIMRSGFTMNDIKGLHYE-DNQEE
SEQ ID NO:4     NWEFLRLSLPVICLPSFIGDQEKQRGWQEIRIRQHRLLS-------QSEHATP-------AHIERIMKSGFSMSDIKGLHRGYSDDPV
SEQ ID NO:6     NWEFLRLSLPVICLPNFIDEQEKQRRWQEIRIRQHRLLS-------QSEHATP-------AHIEQIMKSGFSMSDIKGLHRGYSDDPV
SEQ ID NO:8     NWEFLRLSLPVICHSSFIEESEKLKRWQEIRIRQHRLLV-------EADQTTP-------AHMEQIMKSGLSMSDIKGLHRGYSEDAV
SEQ ID NO:10    NWEFLRLSLPVTCMGEFISEQEKARRWDEIKNRQYRLMR-------EAEIAAQMQVQTQAAHMDHMLKGGFNMNDIKGLTRNFDEHAD
SEQ ID NO:56    NWEFLRLSLPVTCMGEFISEQEKARRWDEIKNRQYRLMR-------EAEIAAQMQVQTQAAHMDHMLKGGFNMNDIKGLTRNFDEHAD
SEQ ID NO:57    NWEFLRLSLPVTCANTFITEQEKMRRWEEIRIRQHRLMT-------EVDHSAP-------AHFDHIMRSGFTMNDIKGLHRNYSEDAA
SEQ ID NO:58    KMEYIKLSLPMPVVCKDFPTSGEMVLSIPVPVLSPGNKRGQWIQQGATSLDLSETDSN---VVSQIRAPGIPKEFDDNKEKKGFLRSMLGSKDSHESDDDRRS
SEQ ID NO:59    PTEYLRLSMPVVCKDFPTSGEMVLSIPVPVLSPGNKRGQWIQQGATSLDLSETDSN---DGTNRRTRSGLDKMEHKAIDTDAIDGDA
SEQ ID NO:60    DIMFYRLSMPIECAEVFSKVAGGLPGAGFYGPKS-------DLEDFDVD------SDFEVLMKTAHGHLVPDRIDKDKETPKP
SEQ ID NO:61    DIMFYRLSMPIECAEVFSKTVPGGLPGAGLFGPKN-------DLEDYDAD------SDFEVLMKTAHGHLVPDRVDKDKETTKA
SEQ ID NO:62    DIMFYRLSMPIECAEVFSKTVAGGLPGAGLFGPKN-------DLEDYDAD------SDFEVLMKTAHGHLVPDRVDKDKBATKP
```

FIGURE 1I

```
SEQ ID NO:2    LPSSKMK--------RLP--SRPPRK---GSMTRGVTIQNYNNLQPGQVNGMHRSTSEAEMAKYDLGAQGLTP-D-DKKDKRGRSPFK
SEQ ID NO:128  LPSSKMK--------RLP--SRPPRK---GSMTRGVTIQNYNNLQPGQVNGMHRSTSEAEMAKYDLGAQGLTP-D-DKKDKRGRSPFK
SEQ ID NO:130  LPSSKMK--------RLP--SRPPRK---GSMTRGVTIQNYNNLQPGQVNGMHRSTSEAEMAKYDLGAQGLTP-D-DKKDKRGRSPFK
SEQ ID NO:144  LPSSKMK--------RLP--SRPPRK---GSMTRGVTIQNYNNLQPGQVNGMHRSTSEAEMAKYDLGAQGLTP-D-DKKDKRGRSPFK
SEQ ID NO:146  LPSSKMK--------RLP--SRPPRK---GSMTR-------------GQVNGMHRSTSEAEMAKYDLGAQGLTP-D-DKKDKRGRSPFR
SEQ ID NO:4    ENDEIMPNTAPLPPRGKNQPPPRPPRK---GSLSRHDDLTIEN-----DGKLNRSSSELNFNIYNHQNGDGQDINKDDKKKRGRSPFR
SEQ ID NO:6    ENDEMMPNTAPLPPRGKNQPPPRPPRK---GSLSRHDDLTIEN-----DGKLNRSSSELNFNIYNQQNGQDINKDDKKKRGRSPFR
SEQ ID NO:8    EADEMMQSTPTTKSKMRQP--SRPPRK---GSLSRNEDMPMING--SLEQSKMNRSTSELDLNRYNADLQN----DKDDKKKRGRSPFR
SEQ ID NO:10   AEADHMM--------RGP--NRPPRK---GSLTRN-----------ITFETDMSAALDEMQRSTSVLDMNGLGE-EMDDKKKRGRSPFK
SEQ ID NO:56   AEADHMM--------RGP--NRPPRK---GSLTRN-----------ITFETDMSAALDEMQRSTSVLDMNGLGE-EMDDKKKRGRSPFK
SEQ ID NO:57   EADEMMR--------NGP--RRPSRHQGRGGLSP------------PGIEINGEATSDGELNAYSDNELEGG---DDRKKRGRSPFR
SEQ ID NO:58   RTNSKQPSVDG----DEP--PAVRRS----LLELP-----------HD-ERQIAEDSMRDLNDRHSEKPKKGLLSRLRDSSNTRKNFR
SEQ ID NO:59   RVNGYNGDTK-----ELT--KKEKKK----LASLP-----------LGRKIPMSRAASSETSVQSPDSSF-----ERSGPSPAKSKRSKFT
SEQ ID NO:60   EFNNHKDYAQ-----EKP--SRLKQR----FLLR------------------------------------------RTKPDYSTGHSARLT
SEQ ID NO:61   EFNNHKDYAQ-----EKP--SRLKQR----FLLR------------------------------------------RTKPDYSTSHSARLT
SEQ ID NO:62   EFNNHKDYAQ-----EKP--SRLKQR----FLLR------------------------------------------RTKPDYSTSHSARLT

SEQ ID NO:2    FFRSK---RGESSDRAKSRKSKTPDPFSDTEVSPERGA---RRPNPQIKVSQANQR-YNGMNARPSRTNLYGSQVGLNSNAQMATPTQD
SEQ ID NO:128  FFRSK---RGESSDRAKSRKSKTPDPFSDTEVSPERGA---RRPNPQIKVSQANQR-YNGMNARPSRTNLYGSQVGLN----MATPTQD
SEQ ID NO:130  FFRSK---RGESSDRAKSRKSKTPDPFSDTEVSPERGA---RRPNPQIKVSQANQR-YNGMNARPSRTNLYGSQVGLN----MATPTQD
SEQ ID NO:144  FFRSK---RGESSDRAKSRKSKTPDPFSDTEVSPERGA---RRPNPQIKVSQANQR-YNGMNARPSRTNLYGSQVGLN----MATPTQD
SEQ ID NO:146  FFRSK---RGESSDRAKSRKSKTPDPFSDTEVSPERGA---RRPNPQIKVSQS------------N-AQ-------------MATPTQD
SEQ ID NO:4    FFSRK---KEGPSDNPKRAKTPDPARNVDRPRNAAHRPNTLNERVTPQIRVSQMDLK-LVPPAIPDR---------------------PGG
SEQ ID NO:6    FFSRK---KEGPSDNPKRAKTPDPARNVURSRNAAHRPNTLNERITPQIRVSQMDLK-LVPPAIPDR---------------------PGG
SEQ ID NO:8    FFSRK---REASNERSKKAKSPEPNSMMEADRGQMGRS-QHHMRTPTVKVTAPDMK-VIPPTIPER---------------------SNM
SEQ ID NO:10   FFSKKS--RDQSREKMGARTLDTSLERRNTVA---HGR---NVVNQQMTTRAPTLR-LNNAEIPPS---------------------PVPQG
SEQ ID NO:56   FFSKKS--RDQSREKMGARTLDTSLERRNTVA---HGR---NVVNQQMTTRAPTLR-LNNAEIPPS---------------------PVPQG
SEQ ID NO:57   LFGKK---RDQSKDKLKDRRTPEPEPRKS-----------NLKVTQRGQATR-MSNSDLR---------------------------AQA
SEQ ID NO:58   DSDRRKEEKAAQLRQMKANSRSFDAGSLDTSTLPTGQK--DVLASSEMPLSGPGRQLTIKRSSIKKNKK-----------------GKKAEIA
SEQ ID NO:59   KSSSMDSGAKHPEDTLAKPTGYEVDGQRSPGAARRGKK--HDRLRTPEASPPGTLTREYIPLKSDNEGSV-----------------GSDNHGR
SEQ ID NO:60   --------EDVLAG-----------------------------------------------------------------------------
SEQ ID NO:61   --------EDVLAD-----------------------------------------------------------------------------
SEQ ID NO:62   --------EDVLAD-----------------------------------------------------------------------------
```

FIGURE 1J

```
SEQ ID NO:2     RKQMTTSTLAQ------SATETVGN-EIFDAECLKLINEYFYGVRIYPGQDPTHMYIGWVTTQYHLHSKDFNQSK-VTKSSVIITDDYDR
SEQ ID NO:128   RKQMTTSTLAQ------SATETVGN-EIFDAECLKLINEYFYGVRIYPGQDPTHVYIGWVTTQYHLHSKDFNQSK-VTKSSVIITDDYDR
SEQ ID NO:130   RKQMTTSTLAQ------SATETVGN-EIFDAECLKLINEYFYGVRIYPGQDPTHVYIGWVTTQYHLHSKDFNQSK-VTKSSVIITDDYDR
SEQ ID NO:144   RKQMTTSTLAQ------SATETVGN-EIFDAECLKLINEYFYGVRIYPGQDPTHVYIGWVTTQYHLHSKDFNQSK-VTKSSVIITDDYDR
SEQ ID NO:146   RKQMTTSTLAQ------SATETVGN-EIFDAECLKLINEYFYGVRIYPGQDPTHVYIGWVTTQYHLHSKDFNQSK-VTKSSVIIIDDYDR
SEQ ID NO:4     PKAMSFTPTS-------AGIEFVGN-EIFDLECLKLINEYYYGVRIFPGQDPTHVYGWVTTQYHLHTKDFSQNH-VRKSTVTIVDEHNG
SEQ ID NO:6     PKAMSFTPSS-------AGIEFVGN-EIFDLECLKLINEYYYGVRIFPGQDPTHVYVGWVTTQFHLHSKDFSQNH-VRKSTVTIVDEHNR
SEQ ID NO:8     PKQMTGAPLSG------SGIESVGN-EIFDGECLKLINEYFYGVRIFPGQDPTHVYVGWVTTQYHFFANEFNQSK-VRKVTVHTLDEFSR
SEQ ID NO:10    PKQLSGSNLGQ------QPVETSGD-EMFDAECLKLINEYFYGVRIFPGQDPTHVYVGWVTTQYHLHSREFNKNK-VRRGSVYIEDDYEM
SEQ ID NO:56    PKQLSGSNLGQ------QPVETSGD-EMFDAECLKLINEYFYGVRIFPGQDPTHVYVGWVTTQYHLHSREFNKNK-VRRGSVYIEDDYEM
SEQ ID NO:57    PLTPERKGMGS------PQVESFGN-EVYDADCLRLINEYFYGVRIFPGQDPTHVYVGWVTTQYHVHSKEFSQNK-VRHAAIYVEDENEK
SEQ ID NO:58    LEKMEREKKGSIIPMDAQLDVLQEGDAHALVHHKDKVDEYYYGIRIFPGQDPSQVWVGWVTTQYHYYNVNFDGSQVRKCRFSEADHHGT
SEQ ID NO:59    PRLAKLVSMGSSFDVFSKSIDIMSDISEADSIDLSMMTKFYYSVRIFPGQDPTDIHVGWVTPGYHHYSPHFDPSK-TSEVTVNMLGENGG
SEQ ID NO:60    ------------------------DRDDYEYLMQTSTYYYSVRIFPGQEPANVWVGWITSDFHQYDTGFDLDR-VRTVTVTLGDEKGK
SEQ ID NO:61    ------------------------DRDDYDFLMQTSTYYYSVRIFPGQEPANVWVGWITSDFHQYDTGFDLDR-VRTVTVTLGDEKGK
SEQ ID NO:62    ------------------------DRDDYDFLMQTSTYYYSVRIFPGQEPANVWVGWITSDFHQYDTGFDLDR-VRTVTVTLGDEKGK

SEQ ID NO:2     VVENVNRQSCYMVRADELYNEVMAEATAKGASQGMFIGCSVDTSTGSVSFTCEGKDTSFKFKMEPETKLFPAISVEATSKEILQIELGR-
SEQ ID NO:128   VVENVNRQSCYMVRADELYNEVMAEATAKGASQGMFIGCSVDTSTGSVSFTCEGKDTSFKFKMEPETKLFPAIFVEATSKEILQIELGR-
SEQ ID NO:130   VVENVNRQSCYMVRADELYNEVMAEATAKGASQGMFIGCSVDTSTGSVSFTCEGKDTSFKFKMEPETKLFPAIFVEATSKEILQIELGR-
SEQ ID NO:144   VVENVNRQSCYMVRADELYNEVMAEATAKGASQGMFIGCSVDTSTGSVSFTCEGKDTSFKFKMEPETKLFPAIFVEATSKEILQIELGR-
SEQ ID NO:146   VVENVNRQSCYMVRADELYNEVMAEATAKGASQGMFIGCSVDTSTGSVSFTCEGKDTSFKFKMEPETKLFPAIFVEATSKEILQIELGR-
SEQ ID NO:4     ILESIDRQSCYMVRSDELYNEVTNDSSGKAASQGMTIGCFIDIATGLMSFTCEGKETSFKFKMEPDIKLFPAIFVEASSKEILQIELGR-
SEQ ID NO:6     ILESIDRQSCYMVRSDELYNEVTNDSSGKGASQGMAIGCFIDIATGVMSFTCEGKETSFKFKMEPDIKLFPAIFVEASSKEILQIELGR-
SEQ ID NO:8     VNESVDRQSCYMVRSDELFNEVTNDSSGKGASQGMFIGCFVDAATGYISFTCEGKETSHKFKMEPETKLFPAIFVEATSKEILQIELGR-
SEQ ID NO:10    AIERIDRQSCYVVRADELFNEVTQDASGKGASQGMFVGCFVDTATGIIRFTCEGKDTSHRWMMEPDTKLFPAIFVEATSKEILQIELGR-
SEQ ID NO:56    AIERIDRQSCYVVRADELFNEVTQDASGKGASQGMFVGCFVDTATGIIRFTCEGKDTSHRWMMEPDTKLFPAIFVEATSKEILQIELGR-
SEQ ID NO:57    TIEIVNRQSCYMVRADELFNEVTQDSSGKGASQGMFVGCFVDTATGTIRFTCEGKETSHVFLMEPDTKLFPAIFVEATSKEILQIELGR-
SEQ ID NO:58    TVDSVQSQNCYMVNVSELLATT--PDVANTKVSGTLIGCIIDTSIGELSFQVGSTDTGIKFKLEPGAMLFPAAFVTPTATEILQFELGR-
SEQ ID NO:59    VQESSKRRDCFTVCVGDHMDLLI-TPEGRRISSGLVVGCVVDACNGELYFTINGRDISTKYQVEPKTKLFPAVFVKPTSKEMLQFELGRS
SEQ ID NO:60    VHESIKRSNCYMVCAGESMS----PGQGRNNSNGLEIGCVVDAASGLLTFIANGKELSTYYQVEPSTKLFPAVFAQATSPNVFQFELGR-
SEQ ID NO:61    VHESIKRSNCYMVCAGESMS----PGQGRNN-NGLEIGCVVDAASGLLTFIANGKELSTYYQVEPSTKLFPAVFAQATSPNVFQFELGR-
SEQ ID NO:62    VHESIKRSNCYMVCAGESMS----PGQGRNN-NGLEIGCVVDAASGLLTFIANGKELSTYYQVEPSTKLFPAVFAQATSPNVFQFELGR-
```

FIGURE 1K

```
SEQ ID NO:2     ----------------SATSLPLSAAVLPTSDKHVIPQFPPRLKVQCLKPHQWARVPNQSLQVHALKLSGIRGWSMLCEDAVSMLAL
SEQ ID NO:128   ----------------SATSLPLSAAVLPTSDKHVIPQFPPRLKVQCLKPHQWARVPNQSLQVHALKLSDIRGWSMLCEDAVSMLAL
SEQ ID NO:130   ----------------SATSLPLSAAVLPTSDKHVIPQFPPRLKVQCLKPHQWARVPNQSLQVHALKLSDIRGWSMLCEDAVSMLAL
SEQ ID NO:144   ----------------SATSLPLSAAVLPTSDKHVIPQFPPRLKVQCLKPHQWARVPNQSLQVHALKLSDIRGWSMLCEDAVSMLAL
SEQ ID NO:146   ----------------SATSLPLSAAVLPTSDKHVIPQFPPRLKVQCLKPHQWARVPNQSLQVHALKLSDIRGWSMLCEDAVSMLAL
SEQ ID NO:4     ----------------TSTTLPLSAAVLQNSERHVLPQFPPRLKVQCLRPHQWARVPNDSLHIHTLKLSDIRGWSILCEDPVSMIAL
SEQ ID NO:6     ----------------TSTTLPLSAAVLQNSERHVLPQFPPRLKVQCLRPHQWARVPNDSLHIHTLKLSDIRGWSILCEDPVSMIAL
SEQ ID NO:8     ----------------TSTTLPLSAAVLQNSERHVNPQFPPRLKVQCLKPHQWARVPNVSLQVHALKLSDIRGWSMLCEDPMSMLAL
SEQ ID NO:10    ----------------TPTTLPLSAAVLPTSDKHINPQSPPRLKVQCLRPHQWARVPNTALQVHALKLSDVRGWSMLCEDPVSMLAL
SEQ ID NO:56    ----------------TPTTLPLSAAVLPTSDKHINPQSPPRLKVQCLRPHQWARVPNTALQVHALKLSDVRGWSMLCEDPVSMLAL
SEQ ID NO:57    ----------------TPTTLPLSAAVLPTSDKHINPQFPPRLKVQCLKPHQWARVPNTALQVHALKLSDIRGWSMLCEDPVSMLAL
SEQ ID NO:58    IKYTFPLSAAMFKSCEKSLVPFCPPRLTVEQIESVYWARVPNETLRTTALKLSEVRGWSVLCNDPVRIMSV
SEQ ID NO:59    KILERRSSSVQSEIAQMSVNQNCLPLSAAWFRGDTHNPTPQCPSRVEVQVMYTNTWARAPLQTMNIETKKMSDNNGWLVSCPEPVSWLGV
SEQ ID NO:60    ----------------IKNVMPLSAGLFKSEHKNPVPQCPPRLHVQFLSHVLWSRMPNQFLKVDVSRISERQGWLVQCLDPLQFMSL
SEQ ID NO:61    ----------------IKNVMPLSAGLFKSEHKNPVPQCPPRLHVQFLSHVLWSRMPNQFLKVDVSRISERQGWLVQCLDPLQFMSL
SEQ ID NO:62    ----------------IKNVMPLSAGLFKSEHKNPVPQCPPRLHVQFLSHVLWSRMPNQFLKVDVSRISERQGWLVQCLDPLQFMSL

SEQ ID NO:2     HIPEEDRCIDILELIEMDKLLSFHSHTLTLYAALCYQSNYRAAHALCSHADQKQLLYAIQSQYMSGPLRQGFYDLLTALHLESHATTMEA
SEQ ID NO:128   HIPEEDRCIDILEPIEMDKLLSFHSHTLTLYAALCYQSNYRAAHALCTHVDQKQLLYAIQSQYMSGPLRQGFYDLLIALHLESHATTMEA
SEQ ID NO:130   HIPEEDRCIDILELIEMDKLLSFHSHTLTLYAALCYQSNYRAAHALCTHVDQKQLLYAIQSQYMSGPLRQGFYDLLIALHLESHATTMEA
SEQ ID NO:144   HIPEEDRCMDILELIEMDKLLSFHSHTLTLYAALCYQSNYRAAHALCTHVDQKQLLYAIQSQYMSGPLRQGFYDLLIALHLESHATTMEA
SEQ ID NO:146   HIPEEDRCIDILELIEMDKLLSFHSHTLTLYAALCYQSNYRAAHALCTHVDQKQLLYAIQSQYMSGPLRQGFYDLLIALHLESHATTMEA
SEQ ID NO:4     HIPEEDRCIDILELIEMEKLLSFHAHTLTLYAAVCYQANYRAAHILCTHVNQKQLLYAICSEYMSGPLRQGFYDLLIALHLESHATTMEV
SEQ ID NO:6     HIPEEDRCIDILELIEMEKLLSFHAHTLTLYAAVCYQANYRAAHILCTHVNQKQLLYAICSEYMSGPLRQGFYDLLIALHLESHATTMEV
SEQ ID NO:8     HIPEEDRSIDILELIEMEKLLSFHAHTLTLYAAHSLTLYAALCFQSNYRAAHTLCSHVDEKQLLYAIRSDYMSGPLRQGFYDLLIALHLESHAYTMEV
SEQ ID NO:10    RIPEEDRCIDILELIEMDKLLSFHAHTLTLYAAHSLTLYAALCYQSNYRAAHALCQHVDQKQLLYAIRSEYMSGPLRQGFYDLLIALHLESHATTMEV
SEQ ID NO:56    HIPEEDRCIDILELIEIDRLLQFHAHTLTLYAAHSLTLYAALCYQSNYRAAHALCQHVDQKQLLYAIRSEYMSGPLRQGFYDLLISLHLESHATTMEV
SEQ ID NO:57    HIPEEDRCIDILELIEMEMPDMLEFHRQTLNLYCKLASHGNHKVAHTLCQHIDEDQIMYAIKSHYLSGPMRQGFHDLLGLHLMSHTAARNS
SEQ ID NO:58    YIPEKDQSLDILEMIEMPDMLEFHRQTLNLYCKLASHGNHKVAHTLCQHIDEDQIMYAIKSHYLSGPMRQGFHDLLGLHLMSHTAARNS
SEQ ID NO:59    HIPEENRCMDILELVEHEDLLKFHAHTLRLYCSVCSHGNHHVAHALINHVNEDQLMYCLQCPYISGPLRIGYNLLHALHLQTHVSARLK
SEQ ID NO:60    HIPEENRSVDILELTEQEELLKFHYHTLRLYSAVCALGNHRVAHALCSHVDEPQLLYAIENKYMPGLLRAGYYDLLIDIHLSSYATARLM
SEQ ID NO:61    HIPEENRSVDILELTEQEELLKFHYHTLRLYSAVCALGNHRVAHALCSHVDEPQLLYAIENKYMPGLLRTGYYDLLIDIHLSSYATARLM
SEQ ID NO:62    HIPEENRSVDILELTEQEELLKFHYHTLRLYSAVCALGNHRVAHALCSHVDEPQLLYAIENKYMPGLLRAGYYDLLIDIHLSSYATARLM
```

FIGURE 1L

| | |
|---|---|
| SEQ ID NO:2 | CKNEFVIPLGPELKALYEEPDMG--HSLR----SLQTESVRPQMKMTDIA------------------------ESITEISNLYSPYFPLEVVREF |
| SEQ ID NO:128 | CKNEFVIPLGPELKALYEEPDMG--HSLR----SLQTESVRPQMKMTDIA------------------------ESITEISNLYSPYFPLEVAREF |
| SEQ ID NO:130 | CKNEFVIPLGPELKALYEEPDMG--HSLR----SLQTESVRPQMKMTDIA------------------------ESITEISNLYSPYFPLEVVREF |
| SEQ ID NO:144 | CKNEFVIPLGPELKALYEEPDMG--HSLR----SLQTESVRPQMKMTDIA------------------------ESITEISNLYSPYFPLEVVREF |
| SEQ ID NO:146 | CKNEFVIPLGPELKALYEEPDMG--HSLR----SLQTESVRPQMKMTDIA------------------------ESITEISNLYSPYFPLEVVREF |
| SEQ ID NO:4 | CKXEYIIPLGHELTTLYDDPQMG--HSLR----SLQTESVRPQMKMTEISD------------------------VIDNVRNLYSPYFPLQVVREY |
| SEQ ID NO:6 | CKNEYIIPLGHELTALYDDPQMG--HSLR----SLQTESVRPQMKMTEISD------------------------VIDNVRNLYSPYFPLQVVREY |
| SEQ ID NO:8 | CKNEFIIPIGQELKDVYEDPEMC--HSLR----SLKTESVLPTMKMTDKADEPS---------------PSEVVDNIRSLYSPQFPLDVVRDF |
| SEQ ID NO:10 | CKNEYITPLGAELKELYSDEEMQ--HSLR----SLVTESVRPQLRMTEIT------------------------EPIPDIDQLYSPKFPLEVVRQF |
| SEQ ID NO:56 | CKNEYITPLGAELKELYSDEEMQ--HSLR----SLVTESVRPQLRMTEIT------------------------EPIPDIDQLYSPKFPLEVVRQF |
| SEQ ID NO:57 | CKNEYIIPLGSELRELYIDPEMC--HSLR----SLQTLSVRPEMNMTEIAPTPSQSNMPTIVAPDSSSEPIPAIDSLYSPRFPLEVVREF |
| SEQ ID NO:58 | MAKEYVIPLVPQLQIKNVLDPDS---ESRYPQITGESVSMLSQMASEPVK----------KHVSREDEMKLLPPSVDFEALKKH |
| SEQ ID NO:59 | TQDEFIIPLMAGPKPVDEELDISSSMSIKRALSTTKSVSIRPQLNIGPSAD--S---------SHQSFSQSMKASEQAPPGFNHMVLKQH |
| SEQ ID NO:60 | MNNEFIVPMTEETKSITLFPDENKKHGLP---GIGLSTSLRPRMRF------------SSPSFVSISNDCYQYSPEFPLDILKAK |
| SEQ ID NO:61 | MNNEFIVPMTEETKSITLFPDENKKHGLP---GIGLSTSLRPRMQF------------SSPSFVSINNECYQYSPEFPLDILKAK |
| SEQ ID NO:62 | MNNEYIVPMTEETKSITLFPDENKKHGLP---GIGLSTSLRPRMQF------------SSPSFVSISNECYQYSPEFPLDILKSK |

| | | |
|---|---|---|
| SEQ ID NO:2 | VMQALAEAVETNQVHNRDPVGGSNENLFLPLIKLVDRLLLVGMMRDEDVEKLLIMTNPETWDP | S |
| SEQ ID NO:128 | VMQALAEAVETNQVHNRDPVGGSNENLFLPLIKLVDRLLLVGMMRDEDVEKLLIMTNPETWDP | S |
| SEQ ID NO:130 | VMQALAEAVETNQVHNRDPVGGSNENLFLPLIKLVDRLLLVGMMRDEDVEKLLIMTNPETWDP | S |
| SEQ ID NO:144 | VMQALAEAVETNQVHNRDPVGGSNENLFLPLIKLVDRLLLVGMMRDEDVEKLLIMTNPETWDP | S |
| SEQ ID NO:146 | VMQALAEAVETNQVHNRDPVGGSNENLFLPLIKLVDRLLLVGMMRDEDVEKLLIMTNPETWDP | S |
| SEQ ID NO:4 | VMAALEEAVLVNQVHNRDPIGGSNENLFLPLLKLVDRLLLVGMLRDEDVEKLLIMINPETWDP | E |
| SEQ ID NO:6 | VMAALEEAVLVNQVHNRDPIGGSNENLFLPLLKLVDRLLLVGMLRDEDVEKLLIMINPETWDP | E |
| SEQ ID NO:8 | VMAALDEAVQINQLHNRDPVGGSNENYFLPLLKLVDRLLLVGMLRDGDVMKLLIMFSPETWDT | A |
| SEQ ID NO:10 | VMEALKDAVEINQVHNRDPIGWTNENLFLPLIKLVDRLLLTDRLLVGVLTDEDVQRLLVMIDPETWDQ | A |
| SEQ ID NO:56 | VMEALKDAVEINQVHNRDPIGWTNENLFLPLIKLVDRLLLTDRLLVGVLTDEDVQRLLVMIDPETWDQ | A |
| SEQ ID NO:57 | VMSALQEAVQINQVHNRDPIGGSNENLFLPLIKLVDRLLLVGVITNEDVEKLLIMIDPETWDP | S |
| SEQ ID NO:58 | VMESLQSATHHAVMNCRDLIGGDNTNHFEPLFKLFDQLLVIGLINDEELECLLRLIHPQAFD | - |
| SEQ ID NO:59 | VISSLGEAVAHGVSHCRDPIGGNYNNLFVPLLELCDALLVIGEFDDDLKSLLLILIDPATF | D |
| SEQ ID NO:60 | TIQMLTEAVKEGSLHARDPVGGTTEFLFKLFYTLLIMGIFHNEDLKHILQLIEPSVFKEAAVPEEEGGTPEKEISIEDAKLE--GE |
| SEQ ID NO:61 | TIQMLTEAVKEGSLHARDPVGGTTEFLFKLFYTLLIMGIFHNEDLRHILQLIEPSVFKDAATPEEEGDTLEEEPSVEDTKLEGAGE |
| SEQ ID NO:62 | TIQMLTEAVKEGSLHARDPVGGTTEFLFKLFYTLLIMGIFHNEDLKHILQLIEPSVFKEAATPEEESDTLEKELSVDDAKLQGAGE |

FIGURE 1M

```
SEQ ID NO:2     FDKEGKDEHRKGLLHMKMAEGAKLQMCYLLQHLNDIQLRHRVEATIAFAHDFVGDLQTDQLRRYTEIKQ-SDLPSAVAAKKTREFRCPPR
SEQ ID NO:128   FDKEGKDEHRKGLLHMKMAEGAKLQMCYLLQHLNDIQLRHRVEAIIAFAHDFVGDLQTDQLRRYTEIKQ-SDLPSAVAAKKTREFRCPPR
SEQ ID NO:130   FDKEGKDEHRKGLLHMKMAEGAKLQMCYLLQHLNDIQLRHRVEAIIAFAHDFVGDLQTDQLRRYTEIKQ-SDLPSAVAAKKTREFRCPPR
SEQ ID NO:144   FDKGGKDEHRKGLLHMKMAEGAKLQMCYLLQHLNDIQLRHRVEAIIAFAHDFVGDLQTDQLRRYTEIKQ-SDLPSAVAAKKTREFRCPPR
SEQ ID NO:146   FDKEGKDEHRKGLLHMKMAEGAKLQMCYLLQHLNDIQLRHRVEAIIAFAHDFVGDLQTDQLRRYTEIKQ-SDLPSAVAAKKTREFRCPPR
SEQ ID NO:4     FQKDGPDEHRKGLLHMKMAEGAKLQMCYLLHHLCDIQLRHRVESIISFSYQFVNDIQIDQLRRYNEIKQ-SDLPSAVAAKKTREFRCPPR
SEQ ID NO:6     FQKDGPDEHRKGLLHMKMAEGAKLQMCYLLHHLCDIQLRHRVESIISFSYQFVNDIQIDQLRRYNEIKQ-SDLPSAIAAKKTREFRCPPR
SEQ ID NO:8     FEKDGKDEHRKGLLLTMKMAEGAKLQMCYLLHHLYDIQLRHRVESIISFSVDFVGDLQSDQLRRYIEIKQ-SDLPSAVAAKKTKEFRCPPR
SEQ ID NO:10    FEREGKDEHRKGLLLTMKMAEGAKLQMRYLLHHLYDTQLRHRVESIIAFSHDFVGDLQTDQLRRYIEIKQ-SDLPSAVAAKKTREFRCPPR
SEQ ID NO:56    FEREGKDEHRKGLLLTMKMAEGAKLQMCYLLHHLYDTQLRHRVESIIAFSHDFVGDLQTDQLRRYIEIKQ-SDLPSAVAAKKTREFRCPPR
SEQ ID NO:57    FEKEGRDEHRKGLLLTMKMAEGAKLQMCYLLHHLYDVQLRHRVESIIAFAHNYVGDLQQDQLRRYIEIKQ-SDLPSAVAAKKTREFRCPPR
SEQ ID NO:58    -ENYETGTTQKGLITQLELAEPVKIQLVSILDHLCDIQLRYRIESLVAFTEGFVGELQSDQCKRYMEIKQ-TDMPPAEAAKKTKEFRCPPK
SEQ ID NO:59    ETYKKGVSETVGMLQMHLDEPVKLPEPVKLPEPVKLQMCLLLQYLCDCQVRHRIEAIVAFSDDFVEECQADQLRRFLEVRN-TDMPPVIAAKTREFRSTPQ
SEQ ID NO:60    EEAKGGKRPKEGLLQMKLPEPVKLQMCLLLQYLCDCQVRHRIEAIVAFSDDFVAKLQDNQRFRYNEVMQALNMSAALTARKTKEFRSPPQ
SEQ ID NO:61    EEAKMGKRPKEGLLQMKLPEPVKLQMCLLLQYLCDCQVRHRIEAIVAFSDDFVAKLQDNQRFRYNEVMQALNMSAALTARKTKEFRSPPQ
SEQ ID NO:62    EEAKGGKRPKEGLLQMKLPEPVKLQMCLLLQYLCDCQVRHRIEAIVAFSDDFVAKLQDNQRFRYNEVMQALNMSAALTARKTKEFRSPPQ

SEQ ID NO:2     EQMNVILSFKHLEE-----------EDKENCPCGEELIARMNEFHDTLMAHVSLHALQEPDAAENQEPE-AKPGAFGKLYNIINTVKELEEE
SEQ ID NO:128   EQMNAILSFKHLEE-----------EDKENCPCGEELIARMNEFHDTLMAHVSLHALQEPDAAENQEPE-AKPGAFGKLYNIINTVKELEEE
SEQ ID NO:130   EQMNAILSFKHLEE-----------EDKENCPCGEELIARMNEFHDTLMAHVSLHALQEPDAAENQEPE-AKPGAFGKLYNIINTVKELEEE
SEQ ID NO:144   EQMNAILSFKHLEE-----------EDKENCPCGEELIARMNEFHDTLMAHVSLHALQEPDAAENQEPE-AKPGAFGKLYNIINTVKELEEE
SEQ ID NO:146   EQMNAILSFKHLEE-----------EDKENCPCGEELIARMNEFHDTLMAHVSLHALQEPDAAENQEPE-AKPGAFGKLYNIINTVKELEEE
SEQ ID NO:4     EQMNAILGFKNLDI-----------DDKENCLIGDELRERMNEFNERLMKQISLVALQESEDDKSDLNNLNKEGKIKQFYNFINAVKDEANE
SEQ ID NO:6     EQMNAILGFKNLDS-----------DDKENCLIGDELRERMNEFNEKLMKQILLVALQESEDDKLDLNNINREGKIKQFYNFINAVKDEANE
SEQ ID NO:8     EQMNAILGFKNLEE-----------GDIENCPCGDELRERLNSFHEKLMHKVSLLALQEPSEEEASAEEVKKPNALNRLYNFINAVKELEET
SEQ ID NO:10    EQMNQILCFKNLEP-----------DDQDNCTCGLELRGRLGDFHDSLMQKVSLNALQEPDGVEGTAIEEVKTGPITKIYNFINTVKELEEG
SEQ ID NO:56    EQMNQILCFKNLEP-----------DDQDNCTCGLELRGRLGDFHDSLMQKVSLNALQEPDGVEGTAIEEVKTGPITKIYNFINTVKELEEG
SEQ ID NO:57    EQMNAILGYKNLEE-----------DDLENASCGPELRNRLIEFHEKLMGKVSLNALQEPEEPEADKLEEGRPGAMKKLYNFINAVKELEED
SEQ ID NO:58    EQMFRLLMCKVKEERDPELMEEDADVDQCPMAEGLQQQLRDFCELLVGKIGNVKEGDSDDQLALIESEEG----SWVDSFARIVVKVPPP
SEQ ID NO:59    EQMRMLLHFKDG-------------DDGMCPCREDLRSVLLEFHSTLAKHCGVHETQE-EKSTDSRGVIR------RFLSWLSGSR--KDA
SEQ ID NO:60    EQINMLLNFKD--------------DKSECPCPEEIRDQLLDFHEDLMTHCGIELDEDGSLDGSNDLTIRG-----RLLSLVEKVTYLKKK
SEQ ID NO:61    EQINMLLNFKD--------------DKSECPCPEEIRDQLLDFHEDLMTHCGIELDEDGSLDGNSDLTIRG-----RLLSLVEKVTYLKKK
SEQ ID NO:62    EQINMLLNFKD--------------DKSECPCPEEIRDQLLDFHEDLMTHCGIELDEDGSLDGNSDLTIRG-----RLLSLVEKVTYLKKK
```

FIGURE 1N

```
SEQ ID NO:2     AKAIEEPPKKTPEEKFRKVLIQTIVNWAEESQIETPKLVREMFSLLVRQYDAVGELIRALEKTYVINAKTKLDVAEMWVGLSQIRALLPV
SEQ ID NO:128   AKAIEEPPKKTPEEKFRKVLIQTIVNWAEESQIETPKLVREMFSLLVRQYDAVGELIRALEKTYVINAKTKLDVAEMWVGLSQIRALLPV
SEQ ID NO:130   AKAIEEPPKKTPEEKFRKVLIQTIVNWAEESQIETPKLVREMFSLLVRQYDAVGELIRALEKTYVINAKTKLDVAGMWVGLSQIRALLPV
SEQ ID NO:144   AKAIEEPPKKTPEEKFRKVLIQTIVNWAEESQIETPKLVREMFSLLVRQYDAVGELIRALEKTYVINAKTKLDVAEMWVGLSQIRALLPV
SEQ ID NO:146   AKAIEEPPKKTPEEKFRKVLIQTIVNWAEESQIETPKLVREMFSLLVRQYDSVGELIRALEKTYVINFKTKEDVAQMWVGLSQIRSLLPV
SEQ ID NO:4     DGLN-EHEKKIPEEIFRKVLISTIVSWAEETQIETPKLVREMFSLLVRQYDSVGELIRALEKTYVINFKTKEDVAQMWVGLSQIRSLLPV
SEQ ID NO:6     NGLN-EHEKKIPEEIFRKVLITTIVSWAEETQIETPKLVREMFSLLVRQYDTVGELIRALGKTYVINSKTKDDAALMWVGLSQIRALLPV
SEQ ID NO:8     PQIEEEPEKKTPEEIFRKVLFRKVLISTIVKAEETQIESPKLVREMFSLLLRQYDTVGELVRALEKTYVINTRARDDVAEMWVGLSQIRALLPV
SEQ ID NO:10    PKEVEEPEKKTPEEVFRKVLIKTIVSWAEESQIENPKLVREMFSLLLRQYDTVGELVRALEKTYVINTRARDDVAEMWVGLSQIRALLPV
SEQ ID NO:56    PKEVEEPEKKTPEEVFRKVLIKTIVSWAEESQIENPKLVREMFGLLVRQYDTIGELIKALNKTYVINSKTKGDVANMWIGLSQIRALLPV
SEQ ID NO:57    PKEPVEEEKKTPEEVFRKVLIKQLVSWAEESQIENPKLVREMFGLLVRQYDTIGELIKALNKTYVINSKTKGDVANMWIGLSQIRALLPV
SEQ ID NO:58    VLEEGMEMQKKGTQNFREIIVTMLREWAQADFIESKSLIRNMFRLLLRQYSGIREIRDAMSQTYVFHERNEKDVTDFLVYLIQIRELLTV
SEQ ID NO:59    SPAGAILQEKFSSDSLSHLISNTMIKWAEEKHIEDPTLVREMFNLLHRQYDGVGELCSALQKSYVVSSNQRDDIVHLLTSLGQIRSLLTV
SEQ ID NO:60    QAEKPVASDSRKCSSLQQLISETMVRWAQESVIEDPELVRAMFVLLHRQYDGIGLVRALPKTYTINGVSVEDTINLLASLGQIRSLLSV
SEQ ID NO:61    QTEKPVESDSRKSSTLQQLISETMVRWAQESVIEDPELVRAMFVLLHRQYDGIGLVRALPKTYTINGVSVEDTINLLASLGQIRSLLSV
SEQ ID NO:62    QAEKPVESDSKKSSTLQQLISETMVRWAQESVIEDPELVRAMFVLLHRQYDGIGLVRALPKTYTINGVSVEDTINLLASLGQIRSLLSV

SEQ ID NO:2     QMSQEEEELMRKRLWKLVNNHTFFQHPDLIRVLRVHENVMAVMMNTLGRRAQAQS---DAQPSSQPVAED---------------------
SEQ ID NO:128   QMSQEEEELMRKRLWKLVNNHTFFQHPDLIRVLRVHENVMAVMMNTLGRRAQAQS---DAQPSSQPVAED---------------------
SEQ ID NO:130   QMSQEEEELMRKRLWKLVNNHTFFQHPDLIRVLRVHENVMAVMMNTLGRRAQAQS---DAQPSSQPVAED---------------------
SEQ ID NO:144   QMSQEEEELMRKRLWKLVNNHTFFQHPDLIRVLRVHENVMAVMMNTLGRRAQAQS---DAQPSSQPVAED---------------------
SEQ ID NO:146   QMSQEEEELMRKRLWKLVNNHTFFQHPDLIRVLRVHENVMAVMMNTLGRRAQAQS---DAQPSSQPVAED---------------------
SEQ ID NO:4     QMSQEEEELMRERLWKLVNNHTFFQHPDLIRVLRVHENVMAVMMNTLGRRAQAQS---DAQPSSQPVAED---------------------
SEQ ID NO:6     QMSQEEEELMRERLWKLVNNHTFFQHPDLIRVLRMHENVMAVMMNTPGRRAQAQSQ-PGGTPVTGQDGEIV--------------------
SEQ ID NO:8     QMSQEEEGLMRERLWKLVNNHTFFQHPDLIRVLRVHENVMAVMMNTLGRRAQAQSQ-PGGTTVTGQDGEIV--------------------
SEQ ID NO:10    QMSQEEEELMRKRLWKLVNNHTFFQHPDLIRVLRVHENVMAVMMNTLGRRAQAQS---DAPQAGQEGEPV---------------------
SEQ ID NO:56    QMSQEEEELMRKRLWKLVNNATFFQHPDLIRILRVHENVMAVMMNTLGRRAQAQS---DAPTQSEVAEGAP--------------------
SEQ ID NO:57    QMSQEEEELMRKRLWKLVNNHTFFQHPDLIRILRVHENVMAVMMNTLGRRAQAQS---DAPTQSEVAEGAP--------------------
SEQ ID NO:58    QFEHTEEAILKRGLWKLMNNRIFFQHPDLMRLLSVHENVMSIMMNILTAQQG------DAPVQTADGEESA--------------------
SEQ ID NO:59    QMGSVEEEALIKHLWEVTDNKVFYQHPNLMRALCVHETVMNVMVNVLEKHQTSIQLTSDEEAESSAQGQGVTGASTAAAPPKTQVCVYRF
SEQ ID NO:60    RMGKEEEKLMIRGLGDIMNNKVFYQHPNLMRALGMHETVMEVMVNVLGGGE-------TVEHEGDELKEK---------------------
SEQ ID NO:61    RMGKEEEKLMIRGLGDIMNNKVFYQHPNLMRALGMHETVMEVMVNVLGGGE------------------------------------
SEQ ID NO:62    RMGKEEEKLMIRGLGDIMNNKVFYQHPNLMRALGMHETVMEVMVNVLGGGE------------------------------------
```

FIGURE 10

```
SEQ ID NO:2    ----NKEKDTSHEMVVACCRFLCYFCRTGRQNQKAMFDHFDFLLENSNILLSRPSLRGSTPLDVAYSSLMENTELALALREHYLEK
SEQ ID NO:128  ----SKEKDTSHEMVVACCRFLCYFCRTGRQNQKAMFDHFDFLLENSNILLSRPSLRGSTPLDVAYSSLMENTELALALREHYLEK
SEQ ID NO:130  ----NKEKDTSHEMVVACCRFLCYFCRTGRQNQKAMFDHFDFLLENSNILLSRPSLRGSTPLDVAYSSLMENTELALALREHYLEK
SEQ ID NO:144  ----NKEKDTSHEMVVACCRFLCYFCRTGRQNQKAMFDHFDFLLENSNILLSRPSLRGSTPLDVAYSSLMENTELALALREHYLEK
SEQ ID NO:146  ----NKEKDTSHEMVVACCRFLCYFCRTGRQNQKAMFDHFDFLLENSNILLSRPSLRGSTPLDVAYSSLMENTELALALREHYLEK
SEQ ID NO:4    ----PKEKDTSHEMVVACCRFLCYFCRTGRQNQKAMFDHFSFLLENSNILLSRPSLRGSTPLDVAYSSLMENTELALALREHYLEK
SEQ ID NO:6    ----PKEKDTSHEMVVACCRFLCYFCRTSRQNQKAMFDHFSFLLENSNILLSRPSLRGSTPLDVAYSSLMENTELALALREHYLEK
SEQ ID NO:8    ----AKEKDTSHEMVVACCRFLCYFCRTSRQNQKAMFDHFAFLLENSNILLSRPSLRGSTPLDVAYSSLMENTELALALREHYLEK
SEQ ID NO:10   ----SKEKDTSHEMVVACCRFLCYFCRTGRQNQKAMFDHFDFLLDNANILLARPSLRGSTPLDVAYSSLMENTELALALREHYLEK
SEQ ID NO:56   ----SKEKDTSHEMVVACCRFLCYFCRTGRQNQKAMFDHFDFLLDNANILLARPSLRGSTPLDVAYSSLMENTELALALREHYLEK
SEQ ID NO:57   ----PKEKDTSHQMVACCRFLCYFCRTGRMNQKAMFDHFDFLLENSNILLSRPSLRGSVPLDVAYSSFMDNNELALALKEEELDK
SEQ ID NO:58   ----APIKDASEMVACSRFLCYFCRTSRQNQKAMFEHLSFLLDNATMLLARPSLRGSCPLDVAAASLMDNNELALALREQHLEK
SEQ ID NO:59   LARRARMCHSKDRFARALIAGCCRFLCYFCRLCYFCRTSRQNQRALFDTLLYLLDHGFIGLSYPSLRGSCPLDVAAASMDNNELALALREPDLEK
SEQ ID NO:60   ----SKEITFPKMVANCCRFLCYFCRISRQNQKAMFDHLSYLLENSSVGLASPAMRGSTPLDVAAASVMDNNELALALREPDLEK
SEQ ID NO:61   ----SKEITFPKMVANCCRFLCYFCRISRQNQKAMFDHLSYLLENSSVGLASPAMRGSTPLDVAAASVMDNNELALALREPDLEK
SEQ ID NO:62   ----SKEITFPKMVANCCRFLCYFCRISRQNQKAMFDHLSYLLENSSVGLASPAMRGSTPLDVAAASVMDNNELALALREPDLEK

SEQ ID NO:2    IAV-YLSRCGLQSNSELVEKGYPDLGWDPVEGERYLDFLRFCVWVNGESVEENANLVIRLLIRRPECLGPALRGEG-EGLLKAIVDANKM
SEQ ID NO:128  IAV-YLSRCGLQSNSELVEKGYPDLGWDPVEGERYLDFLRFCVWVNGESVEENANLVIRLLIRRPECLGPALRGEG-EGLLKAIVDANKM
SEQ ID NO:130  IAV-YLSRCGLQSNSELVEKGYPDLGWDPVEGERYLDFLRFCVWVNGESVEENANLVIRLLIRRPECLGPALRGEG-EGLLKAIVDANKM
SEQ ID NO:144  IAV-YLSRCGLQSNSELVEKGYPDLGWDPVEGERYLDFLRFCVWVNGESVEENANLVIRLLIRRPECLGPALRGEG-EGLLKAIVDANKM
SEQ ID NO:146  IAV-YLSRCGLQSNSELVEKGYPDLGWDPVEGERYLDFLRFCVWVNGESVEENANLVIRLLIRRPECLGPALRGEG-EGLLKAIVDANKM
SEQ ID NO:4    IAI-YLSRCGLQSNSELIEKGYPDLGWDPVEGERYLDFLRFCVWVNGESVEENANLVIRLLIRRPECLGPALRGEG-EGLLRAIIDANKM
SEQ ID NO:6    IAI-YLSRCGLQSNSELIEKGYPDLGWDPVEGERYLDFLRFCVWVNGESVEENANLVIRLLIRRPECLGPALRGEG-EGLLRAIIDANKM
SEQ ID NO:8    IAI-YLSRCGLQSNSELIEKGYPDLGWDPVEGERYLDFLRFCVWVNGESVEENANLVIRLLIRRPGCLGPALRGEG-EGLLRAIVDANKM
SEQ ID NO:10   IAV-YLSRCGLQSNSELVEKGYPDLGWDPVEGERYLDFLRYCVWVNGESVEENANLVIRLLIRRPECLGPALRGEG-EGLFRAIVEANRM
SEQ ID NO:56   IAV-YLSRCGLQSNSELVEKGYPDFLRYCVWVNGESVEENANLVIRLLIRRPECLGPALRGEG-EGLFRAIVEANRM
SEQ ID NO:57   IAI-YLSRCGLQSNSELIERGYPDLGWDPVEGERYIDFLRFCVWINGENVEENANLVIVMLIRHPECLGPALRGEG-EGLLKAIVDANKM
SEQ ID NO:58   VAV-YLSRCGLQPNSELITKGYPDIGWDPVEGERYLDFLRFMRHAVWVNGETVEENANLIVRMLIRHPECLGPALRGEG-QGLFSAFKEAIAL
SEQ ID NO:59   VIT-FLSRCGVQDNARLRAMGNPYLDGTPLDGERYLDFMRHAVWVNGETVEENANLIVRMLIRHPECLGPALRGEG-KGLLAAMEEAIDL
SEQ ID NO:60   VVARYLAGCGLQSCQMLVSKGYPDIGWNPVEGERYLDFLRFAVFCNGESVEENANVVRLLIRRPECFGPALRGEGNGLLAAMEEAIKI
SEQ ID NO:61   VVR-YLAGCGLQSCQMLVSKGYPDIGWNPVEGERYLDFLRFAVFCNGESVEENANVVRLLIRRPECFGPALRGEGNGLLAAMEEAIKI
SEQ ID NO:62   VVR-YLAGCGLQSCQMLVSKGYPDIGWNPVEGERYLDFLRFAVFCNGESVEENANVVRLLIRRPECFGPALRGEGNGLLAAMEEAIKI
```

FIGURE 1P

```
SEQ ID NO:2    SERIADRRKLRE-------MEQ--EGDVNFSHPLPESDED-EDYIDTGAAILNFYCTLVDLLGRCAPDAGVIALGKNESLRARAILRSLVP
SEQ ID NO:128  SERIADRRKLRE-------MEQ--EGDVNFSHPLPESDED-EDYIDTGAAILNFYCTLVDLLGRCAPDAGVIALGKNESLRARAILRSLVP
SEQ ID NO:130  SERIADRRKLRE-------MEQ--EGDVNFSHPLPESDED-EDYIDTGAAILNFYCTLVDLLGRCAPDAGVIALGKNESLRARAILRSLVP
SEQ ID NO:144  SERIADRRKLRE-------MEQ--EGDVNFSHPLPESDED-EDYIDTGAAILNFYCTLVDLLGRCAPDAGVIALGKNESLRARAILRSLVP
SEQ ID NO:146  SERIADRRKLRE-------MEQ--EGDVNFSHPLPESDED-EDYIDTGAAILNFYCTLVDLLGRYAPDSSVISLGKNESLRARAILRSLVP
SEQ ID NO:4    SERITERRKFLE-------ES-GNQENIQLDHPLPESDDD-EDYIDTGAAILNFYCTLVDLLGRCAPDSSVIALGKNESLRARAILRSLVP
SEQ ID NO:6    SERIAERRKFLE-------ES-GNQENIQLDHPLPESEDD-EDYIDTGAAILNFYCTLVDLLGRCAPDSSVIAQGKNESLRARAILRSLVP
SEQ ID NO:8    SERIADRRKVMD-------EPEGTTMVMHFEHPLPESDDD-EDYIDTGAAILAFYCTLVDLLGRCAPDASVIEQGKNESLRARAILRSLVP
SEQ ID NO:10   SERISDRCKMQD-------EAEGTIAGLNFTHPLPEGEED-EDYIDTGAAILNFYCTLVDLLGRCAPDASVIEQGKNESLRARAILRSLVP
SEQ ID NO:56   SERISDRCKMQD-------EAEGTIAGLNFTHPLPEGEED-EDYIDTGAAILNFYCTLVDLLGRCAPDAAVIEQGKNESLRARAILRSLVP
SEQ ID NO:57   SERISERRKMQD-------EAEGTITGLNFSHPLPEGDDD-EDYIDTGAAILCFYCTLVDLLGRCAPDPMAIQAGKGDSLRARAILRSLIS
SEQ ID NO:58   SEDIRLLENDSHP-----SLLSSGLLGENPTYPSKDAEGEDYIDLGAATLDFYSSLVDLLAKCAPDPMAIQAGKGDSLRARAILRSLIS
SEQ ID NO:59   SETAEEGYLISAPTMAISEEDGEVRPIDASGQDEEGDED-EDDVDTGGAILTFYATLIDLLGRCAPDENRLSQGRTEPQRIAILQSLVP
SEQ ID NO:60   AEDPSR-----------------DGPSPTSGSSKTLDIEEEE-DDTIHMGNAIMTFYAALIDLLGRCAPEMHLIHAGKGEAIRIRSILRSLIP
SEQ ID NO:61   AEDPSR-----------------DGPSPTSGSSKTLDTEEEE-DDTIHMGNAIMTFYAALIDLLGRCAPEMHLIHAGKGEAIRIRSILRSLIP
SEQ ID NO:62   AEDPSR-----------------DGPSPNSGSSKTLDTEEEE-DDTIHMGNAIMTFYSALIDLLGRCAPEMHLIHAGKGEAIRIRSILRSLIP

SEQ ID NO:2    LEDLQGVLSLRFTLNNPAA--------GEERPKSDMPSGLIPGHKQSVGLFLGRVYGIETQELFYKLLEEAFLPDLRAATMLDRNDGCES
SEQ ID NO:128  LEDLQGVLSLRFTLNNPAA--------GEERPKSDMPSGLIPGHKQSVGLFLERVYGIETQELFYKLLEEAFLPDLRAATMLDRNDGCES
SEQ ID NO:130  LEDLQGVLSLRFTLNNPAA--------GEERPKSDMPSGLIPGHKQSVGLFLERVYGIETQELFYKLLEEAFLPDLRAATMLDRNDGCES
SEQ ID NO:144  LEDLQGVLSLRFTLNNPAA--------GEERPKSDMPSGLIPGHKQSVGLFLERVYGIETQELFYKLLEEAFLPDLRAATMLDRNDGCES
SEQ ID NO:146  LEDLQGVLSLRFTLNNPAA--------GEERPKSDMPSGLIPGHKQSVGLFLERVYGIETQELFYKLLEEAFLPDLRAATMLDRNDGCES
SEQ ID NO:4    LEDLQGVLSLRFTLQNPAA--------GQDRPKSDMPSGLIPGHKQSIVLFLERVYGIEMQELFFTLLEEAFLPDLRTATMLDRNDGLES
SEQ ID NO:6    LEDHGVLSLRFTLQNPAA--------GQDRPKSDMPSGLIPGHKQSVVLFLERVYGIEMQELFFTLLEEAFLPDLRTATMLDRNDGLES
SEQ ID NO:8    LEDHGVLSLRFTLQNPAA--------GEERPKSDMPSGLIPGHKQSVGLFLERVYGIETQELFFRLLEEAFLPDLRTATILDRNDGSES
SEQ ID NO:10   LEDLQGVLSLKFTLSQTAP--------GEEKPKSDMPSGLLPNNKQSIVLFLERVYGIEAQDLFYRLLEDAFLPDLRTATILDKSDGSES
SEQ ID NO:56   LEDLQGVLSLKFTLSQTAP--------GEEKPKSDMPSGLLPNNKQSIVLFLERVYGIEAQDLFYRLLEDAFLPDLRTATILDKSDGSES
SEQ ID NO:57   LEDLQGVLSLKFTLTNPAL--------GEDRPKSDMPSGLVPGHKQSIVLFLERVYGIETQELFYRLLEDAFLPDLRAATMLDRSDGSES
SEQ ID NO:58   LDDLGQILALRFTIPNLAAP-------SIEDTGPLPGLLPNHKGSVLLFLDRVYGIDQQDMLFHVLEQSFLPDLRAATMMDSPRALES
SEQ ID NO:59   LDDLVGVLNLKFILPSPQKIYEKKDDGAGKPLGADLKG-LTPVHKEAMLLFLERVYGVGNQELFFELLEVGFLPDLRAATTMDTPTTHDH
SEQ ID NO:60   LGDLVGVISIAFQMPTIAK--------DGKVVEPDMSAGFCPDHKAAMVLFLDRVYGIEVQDFLLHLLEVGFLPDLRAAASLDTAALSAT
SEQ ID NO:61   LGDLVGVISIAFQMPTIAK--------DGNVVEPDMSAGFCPDHKAAMVLFLDRVYGIEVQDFLLHLLEVGFLPDLRAAASLDTAALSAT
SEQ ID NO:62   LGDLVGVISIAFQMPTIAK--------DGNVVEPDMSAGFCPDHKAAMVLFLDRVYGIEVQDFLLHLLEVGFLPDLRAAASLDTAALSAT
```

FIGURE 1Q

```
SEQ ID NO:2     DMALSMNRYIGNSILPLLIKHAYFYNEAENYASLLDATLHTVYRLSKNRMLTKGQREAVSDFLVALTSAMQPSMLLKLLRKLTVDVSKLS
SEQ ID NO:128   DMALSMNRYIGNSILPLLIKHAYFYNEAENYASLLDATLHTVYRLSKNRMLTKGQREAVSDFLVALTSAMQPSMLLKLLRKLTVDVSKLS
SEQ ID NO:130   DMALSMNRYIGNSILPLLIKHAYFYNEAENYASLLDATLHTVYRLSKNRMLTKGQREAVSDFLVALTSAMQPSMLLKLLRKLTVDVSKLS
SEQ ID NO:144   DMALSMNRYIGNSILPLLIKHAYFYNEAENYASLLDATLHTVYRLSKNRMLTKGQREAVSDFLVALTSAMQPSMLLKLLRKLTVDVSKLS
SEQ ID NO:146   DMALSMNRYIGNSILPLLIKHAYFYNEAENYASLLDATLHTVYRLSKNRMLTKGQREAVSDFLVALTSQMQPSMLLKLLRKLTVDVSNLS
SEQ ID NO:4     DMALAMNRYIGKSVLPLLIGHSKFYSESGNYANLLDATLHTVYRLSKNRMLTKGQREAVSDFLVALTSQMQPSMLLKLLRKLTVDVSNLS
SEQ ID NO:6     DMALAMNRYIGNSVLPLLIGHSKFYSESDNYANLLDATLHTVYRLSKNRMLTKGQREAVSDFLVALTSQMQPSMLLKLLRKLTVDVSKLT
SEQ ID NO:8     DMALAMNRYIGNSILPLLITHSKFYNEADNYASLLDATLHTVYRLSKNRMLTKGQREAVSDFLVALTSSMQPSMLLKLLRKLTVDVSKLS
SEQ ID NO:10    DMALAMNRYIGNSILPLLIKHSKFYNEAENYASLLDATLHTVYRLSKNRMLTKGQREAVSDFLVALTSQMQPAMLLKLLRKLTVDVSKLS
SEQ ID NO:56    DMALSMNRYIGNSILPLLIKHSKFYNEAENYASLLDATLHTVYRMSKNRMLTKGQREAVSDFLVALTSAMHPAMLLKLLRKLTIDVSKLS
SEQ ID NO:57    DTALALNRYICNSVLPLLTNHSHFFADAEHHSALIDATLHTVYRMNRLKSLTKNQRDAVSDFLVAITRELPPAAMIKLLKKVITDILTMN
SEQ ID NO:58    DMALALNRYICNSVLPLLTNHSEMFESADQFASLLDSTLHTVYRLASCRSLTRGQRDTVADFLVALTRSLKPSMMQRLLRKLINDVPVLA
SEQ ID NO:59    DMALALNRYLCTAVLPLLTRHSEMFESADQFASLLDSTLHTVYRLASCRSLTRGQRDTVADFLVALTRSLKPSMMQRLLRKLINDVPVLA
SEQ ID NO:60    DMALALNRYLCTAVLPLLTRCARLFAGTEHHASLLIDSLLHTVYRLSKGCSLTKAQRDSIEVCLLSICGQLRPSMQHLLRLLVFDVPLLN
SEQ ID NO:61    DMALALNRYLCTAVLPLLTRCAPLFAGTEHHASLIDSLLHTVYRLSKGCSLTKAQRDSIEVCLLSICGQLRPSMQHLLRLLVFDVPLLN
SEQ ID NO:62    DMALALNRYLCTAVLPLLTRCAPLFAGTEHHASLIDSLLHTVYRLSKGCSLTKAQRDSIEVCLLSICGQLRPSMMQHLLRLLVFDVPLLN

SEQ ID NO:2     EY--TTVALRLLTLHYERCAKYYGSTGAG--QGAFGASSDEEKRLTMMLFSSIFDSLSKMDYEPELFGKALPCLIAIGCALPPDYTLSKNYD
SEQ ID NO:128   EY--TTVALRLLTLHYERCAKYYGSTGAG--QGAFGASSDEEKRLTMMLFSNIFDSLSKMDYEPELFGKALPCLIAIGCALPPDYSLSKNYD
SEQ ID NO:130   EY--TTVALRLLTLHYERCAKYYGSTGAG--QGAFGASSDEEKRLTMMLFSNIFDSLSKMDYEPELFGKALPCLIAIGCALPPDYSLSKNYD
SEQ ID NO:144   EY--TTVALRLLTLHYERCAKYYGSTGAG--QGAFGASSDEEKRLTMMLFSNIFDSLSKMDYEPELFGKALPCLIAIGCALPPDYSLSKNYD
SEQ ID NO:146   EY--TTVALRLLTLHYERCAKYYGSTGAG--QGAFGASSDEEKRLTMMLFSNIFDSLSKMDYEPELFGKALPCLIAIGCALPPDYSLSKNYD
SEQ ID NO:4     EY--TTVALRLLTLHYERCAKYYGSTGG---QGIYGASSDEEKRLTMMLFSNIFDSLSKMDYDPELFGKALPCLSAIGCALPPDYSLSKNYD
SEQ ID NO:6     EY--TTVALRLLTLHYDRCAKYYGSTGG---QGIYGASSDEEKRLTMMLFSNIFDSLSKMDYDPELFGKALPCLSAIGCALPPDYSLSKNHD
SEQ ID NO:8     EY--TTVALRLLTLHYDRCAKYYGSTGG---QGLYGSSSDEEKRLTMMLFSNIFDSLSKMDYDPELFGKALPCLTAIGCALPPDYSLSKNYD
SEQ ID NO:10    EY--TTVALRLLTLHYDRCAKYYGSTQG---QGSYGASSDEEKRLTMMLFSNIFDSLSNMDYDPELFGKALPCLIAIGCALPPDYSLSKNTD
SEQ ID NO:56    EY--TTVALRLLTLHFDRCAKYYGSTQG---QGSYGASSDEEKRLTMMLFSNIFDSLSNMDYDPELFGKALPCLIAIGCALPPDYSLSKNTD
SEQ ID NO:57    EY--TTVALRLLTLHFDRCAKYYGSTQG---QGSYGASSQFGASSDEEKRLTMMLFDAIFDTLGSRPYDPELFGKALPCMTAIGSAISPDYTLTSGLE
SEQ ID NO:58    DMNVLVPLRLITLHYERCGKYYGSNGG----YGVASEQEKRLSMLLFDAIFDTLGLFDALAEKEYDEELFDRALPCLTAIGSALPPDYSMSYN--
SEQ ID NO:59    EY--SYVALKILQLHYERCVSYYGSNGG---WGSYGAANDEEKRLTMLFTGLFDALSQKKYEQELFKLALPCLSAVAGALPPDYMESNY--
SEQ ID NO:60    EH--AKMPLKLLTNHYERCWKYYCLPGG---WGNFGAASEEELHLSRKLFWGIFDALSQKKYEQELFKLALPCLSAVAGALPPDYMESNY--
SEQ ID NO:61    EH--AKMPLKLLTNHYERCWKYYCLPGG---WGNFGAASEEELHLSRKLFWGIFDALSQKKYEQELFKLALPCLSAVAGALPPDYMESNY--
SEQ ID NO:62    EH--AKMPLKLLTNHYERCWKYYCLPGG---WGNFGAASEEELHLSRKLFWGIFDALSQKKYEQELFKLALPCLSAVAGALPPDYMESNY--
```

FIGURE 1R

```
SEQ ID NO:2     DEFYGKEQAAGDLDNPQYDPQPINTSSVALNNDLNTIVQKFSEHYHDAWASRKIENGWVYGEGWSDSQKTHPRLKPYNMLNDY------EK
SEQ ID NO:128   DEFYGKEQAAGDLDNPQYDPQPINTSSVALNNDLNTIVQKFSEHYHDAWASRKIENGWVYGEGWSDSQKTHPRLKPYNMLNDY------EK
SEQ ID NO:130   DEFYGKEQAAGDLDNPQYDPQPINTSSVALNNDLNTIVQKFSEHYHDAWASRKIENGWVYGEGWSDSQKTHPRLKPYNMLNDY------EK
SEQ ID NO:144   GEFYGKEQAAGDLDNPQYDPQPINTSSVALNNDLNTIVQKFSEHYHDAWASRKIENGWVYGEGWSDSQKTHPRLKPYNMLNDY------EK
SEQ ID NO:146   DEFYGKEQAAGDLDNPQYDPQPINTSSVALNNDLNTIVQKFSEHYHDAWASRKIENGWVYGEQFNDVNKSHPRLKPYMMLSEY------EK
SEQ ID NO:4     DEWYGSKQNIQGPSDGPYNPQPINTNSIVLDNDLNSIVHKFSEHYHDAWANRKLENGWVYGEQFNDVNKSHPRLKPYMMLSEY------EK
SEQ ID NO:6     DEWYGSKQNIQGPSDGPYNPQPINTNSIVLDNDLNSIVHKFSEHYHDAWANRKLENGWVYGEQFNDVNKSHPRLKPYMMLSEY------EK
SEQ ID NO:8     DELYGARDSQAGPSDGPYNPQPINTHSVVLNNDLNTIVQKFSEHYHDAWASRKLENGWTYGDQWSDSQKTHPRLKPYNMLNDYVEPSIER
SEQ ID NO:10    EDYYGRQMG--APDQPQYMPNPIDTNNVHLDNDLNSLVQKFSEHYHDAWASRRLEGGWTYGDIRSDNDRKHPRLKPYNMLSEY------ER
SEQ ID NO:56    EDYYGRQMG--APDQPQYMPNPIDTNNVHLDNDLNSLVQKFSEHYHDAWASRRLEGGWTYGDIRSDNDRKHPRLKPYNMLSEY------ER
SEQ ID NO:57    DDLYGKPTGG--GPDQPHYNPQPIDTTAVQLTNDLNQIVQKFSEHYHDAWASRKLENGWTYGDWSDANKTHPRLKPYNTLSEY------ER
SEQ ID NO:58    DVRNKRREE-----EGAWIPRTVDVSRCEINRDLEKMTELFAEHFHDSWASRKLEKGWVHGDLYSRANFTHPRLKPFALLKDF------EK
SEQ ID NO:59    DESYVRESC--FDADGIYQPKPVDSNKVLLNESLLSFSDRFAEHLHDSWALAMFDNGWTHGEAENSAMKESCMLRPYKTLTTK------EK
SEQ ID NO:60    VSMMEKQSS--MDSEGNFNPQPVDTSNITIPEKLEYFINKYAEHSHDKWSMDKLANGWIYGEIYSDSSKIQPLMKPYKLLSEK------EK
SEQ ID NO:61    VSMMEKQSS--MDSEGNFNPQPVDTSNIIIPEKLEYFINKYAEHSHDKWSMDKLANGWIYGEIYSDSSKIQPLMKPYKLLSEK------EK
SEQ ID NO:62    VSMMEKQSS--MDSEGNFNPQPVDTSNITIPEKLEYFINKYAEHSHDKWSMDKLANGWIYGEIYSDSSKVQPLMKPYKLLSEK------EK

SEQ ID NO:2     ERYKEPVRESLKALLAIGWSVEHSEVDIPSNNRSSMGRQSKSGGRPPEIVT--DSATPFNYNPHPVDMTNLTLSREMQNMAERLADNAHD
SEQ ID NO:128   ERYKEPVRESLKALLAIGWSVEHSEVDIPSNNRSSMRRQSKSGGRPPEIVT--DSATPFDYNPHPVDMTNLTLSREMQNMAERLADNAHD
SEQ ID NO:130   ERYKEPVRESLKALLAIGWSVEHSEVDIPSNNRSSMRRQSKSGGRPPEIVT--DSATPFNYNPHPVDMTNLTLSREMQNMAERLADNAHD
SEQ ID NO:144   ERYKEPVRESLKALLAIGWSVEHSEVDIPSNNRSSMRRQSKSGGRPPEIVQT--DSATPFNYNPHPVDMTNLTLSREMQNMAERLADNAHD
SEQ ID NO:146   ERYKEPVRESLKALLAIGWSVEHSEVDIPSNNRSSMRRQSKSGGRPPEIVT--DSATPFNYNPHPVDMTNLTLSREMQNMAERLADNAHD
SEQ ID NO:4     ELYKEPVRESLKALLAIGWSIEHSENDAPLNNRGSVRRQSK------SN----ENVTPFDYHPNPIDMTNLTLTREMQNMAERLAENSHD
SEQ ID NO:6     ELYKEPVRESLKALLAIGWSIEHSENDAPLNNRGSVRRQSK------SN----ENVTPFDYHPNPIDMTNLTLTREMQNMAERLAENSHD
SEQ ID NO:8     ERYKEPVRESIKALLAIGWTVEHSEADVPLTSRGSIRRQSK------PNAMV-DSSTPFNYHPNPIDMTNLTLGREMQNMAERLAENAHD
SEQ ID NO:10    ERYRDPVRECLKGLLAIGWTVEHSEVEVPLNHRGSTRRQSK------PQINE---GSPFNYNPHPVDMSNLTLSREMQNMAERLAENSHD
SEQ ID NO:56    ERYRDPVRECLKGLLAIGWTVEHSEVEVPLNHRGSTRRQSK------PQINEFQNEGSPFNYNPHPVDMSNLTLSREMQNMAERLAENSHD
SEQ ID NO:57    ERYREPVRESLKALLALHWRIEHSEGDVPLSNRGSMRRQSK------PNLELQGDTGSPFNYNPHPVDMTNLTLSREMQNMAERLAENSHD
SEQ ID NO:58    SFYEKRCSECLKALMAWNYSFEMMDRDAN-DRASAARTLSG------------TSISNFAPKPIDLSSMTLEKDMVNAAEKMAEHSHL
SEQ ID NO:59    DSYREPVRECIKALLAWGWSVERSKASEQQSQAHRPRRLSK------ASLGA--MESPHGYNPRPIDVSNITLTREMQTMAERLAENAHD
SEQ ID NO:60    EIYRWPIKESLKTMLAWGWRIERTREGDSMALYNRTRRISQ------TSQVS----IDAAHGYSPRAIDMSNVTLSRDLHAMAEMMAENYHN
SEQ ID NO:61    EIYRWPIKESLKTMLAWGWRIERTREGDSMALYNRTRRISQ------TSQVS----VDAAHGYSPRAIDMSNVTLSRDLHAMAEMMAENYHN
SEQ ID NO:62    EIYRWPIKESLKTMLARTMRTERTREGDSMALYNRTRRISQ------TSQVS----VDAAHGYSPRAIDMSNVTLSRDLHAMAEMMAENYHN
```

FIGURE 1S

```
SEQ ID NO:2    IWAKKKKEELVTNGGGIHPQLVPYDLLTDKEKKKDRERSQEFLKYLQYQGYKLHRPSKAPQ-SDTEQT-TTGVAIELRFAYSLLEKLIQY
SEQ ID NO:128  IWAKKKKEELVTNGGGIHPQLVPYDLLTDKEKKKDRERSQEFLKYLQYQGYKLHRPSKAPQ-SDTEQT-TTGVAIELRFAYSLLEKLIQY
SEQ ID NO:130  IWAKKKKEELVTNGGGIHPQLVPYDLLTDKEKKKDRERSQEFLKYLQYQGYKLHRPSKAPQ-SDTEQT-TTGVAIELRFAYSLLEKLIQY
SEQ ID NO:144  IWAKKKKEELVTNGGGIHPQLVPYDLLTDKEKKKDRERSQEFLKYLQYQGYKLHRPSKAPQ-SDTEQT-TTGVAIELRFAYSLLEKLIQY
SEQ ID NO:146  IWAKKKKEELVTNGGGIHPQLVPYDLLTDKEKKKDRERSQEFLKYLQYQGYKLHRPSKAPQ-SDTEQT-TTGVAIELRFAYSLLEKLIQY
SEQ ID NO:4    IWAKKKKEEVMLCGGGIHNQLVPYDLLTDKEKKKDRERSQEFLKYLQYQGYKLHRPNRNGGPSEAEQL-AAASTGELRFSHSLLEKLIHY
SEQ ID NO:6    IWAKKKKEEVMLCGGGIHNQLVPYDLLTDKEKKKDRERSQEFLKYLQYQGYKLHRPNRNGGPSDABQL-AAASTGELRFSYSLLEKLIHY
SEQ ID NO:8    IWAKKKKEELITCGGGIHPQLVPYDLLTDKEKKKDRERSQEFLKYLQYQGYKLHRPSRTGGPSESEQL-AAQATGELRFAYSLLEKLIQY
SEQ ID NO:10   IWAKKKKNEELNGCGGVIHPQLVPYDLLTDKEKKKDRERSQEFLKYMQYQGYKLHKPSKGG--AVEEGG-ATQAAVELRFSYSLLEKLIQY
SEQ ID NO:56   IWAKKKKNEELNGCGGVIHPQLVPYDLLTDKEKKKDRERSQEFLKYMQYQGYKLHKPSKGG--AVEEGG-ATQAAVELRFSYSLLEKLISY
SEQ ID NO:57   IWAKKKKNEELDQCGGAIHAQLVPYDLLTDKEKKRDRERSQEFLKYLQYQGLKLHKPSRG--QTEEPG-MSTAAIELRFAYSLLEKLITY
SEQ ID NO:58   IWAKKVMNDLNTKGGFMPIPLVPWDLLTDFERRKDRFRASEILKFLQYHGYHVNCPKDEQSQNDRLKSEGERTSVEKRFAYNLLEKLITY
SEQ ID NO:59   VWAKTKLEMELRGSGCHAQLVPFDILTDSEKKKDRDMAQALLKFLQVNGYRLQRHSLS---MDADGIIRGHSTIEKRFAFNLLDKLLHY
SEQ ID NO:60   IWAKKKKLELESKGGGNHPLLVPYDTLTAKEKAKDREKAQDIFKFLQISGYVVSRGFKD----LDLD------TPSIEKRFAYSFLQQLIRY
SEQ ID NO:61   IWAKKKKLELESKGGGNHPLLVPYDTLTAKEKAKDREKAQDILKFLQINGYAVSRGFKD----LELD------TPSIEKRFAYSFLQQLIRY
SEQ ID NO:62   IWAKKKKMELESKGGGNHPLLVPYDTLTAKEKAKDREKAQDILKFLQINGYAVSRGFKD----LELD------TPSIEKRFAYSFLQQLIRY

SEQ ID NO:2    IDRATINMKLLKPST-TFSRRSSFKTSTRDIKFFSKVVLPLMEKYFSTHRNYFIAVATATNSVG--AASLKEKEMVAALFCKLASLLRSR
SEQ ID NO:128  IDRATINMKLLKPST-TFSRRSSFKTSTRDIKFFSKVVLPLMEKYFSTHRNYFIAVATATNNVG--AASLKEKEMVAALFCKLASLLRSR
SEQ ID NO:130  IDRATINMKLLKPST-TFSRRSSFKTSTRDIKFFSKAVLPLMEKYFSTHRNYFIAVATATNNVG--AASLKEKEMVAALFCKLASLLRSR
SEQ ID NO:144  IDRATINMKLLKPST-TFSRRSSFKTSTRDIKFFSKVVLPLMEKYFSTHRNYFIAVATATNNVG--AASLKEKEMVAALFCKLASLLRSR
SEQ ID NO:146  IDRATINMKLLKPSG-TFSRRSSFKTSTRDIKFFSKVVLPLMEKYFSTHRNYFIAVATATNNVG--AASLKEKEMVAALFCKLASLLRSR
SEQ ID NO:4    IDRASINMKLLKPSG-TFSRRSSFKICTRDIKFFSKVVLPLVEKYFSTHRNYFITVATASSVLG--AASLKEKEMVASLFCKLANLLRSK
SEQ ID NO:6    IDRASINMTLLKPSG-TFSRRSSFKICTRDIKFFSKVVLPLVEKYFSTHRNYFITVATASSVLG--AASLKEKEMVASLFCKLANLLRSK
SEQ ID NO:8    IDRATINMKLLKPST-TFSRRSSFKTSTRDIKFFSKVVLPLVEKYFSTHRNYFIAVATASNNIG--AASLKEKEMVASLFCKLANLLRSR
SEQ ID NO:10   LDRATINMKLLKPST-TFSRRSSFKTATRDIKFFSKVVLPLMEKYFSTHRNYFIAIATATNIG--AASLKEKEMVASIFCKLAALLRNR
SEQ ID NO:56   LDRATINMKLLKPST-TFSRRSSFKTATRDIKFFSKVVLPLMEKYFSTHRNYFIAIATATNNIG--AASLKEKEMVASIFCKLAALLRNR
SEQ ID NO:57   SDRATINMKLLKPSS-TFSRRSSFKTCSRDIKFFSKVVLPLMEKYFSTHRNYFSSNRNYFIAIATATNNVG--AASLKEKEMVAGLFCKLASLLRHR
SEQ ID NO:58   LEQASLKMKSVKPSQ-ELTRRNSFKKEGQDVKFFEKVVLPLMHAYFNAHKNYFLEGSSIVQTGT---ASNKEKEMVANLFCRLAALLRIK
SEQ ID NO:59   VDKSQANLKPQRRQQDSFRSSKKESSGDRGYKFFAKVVLPLIEKYFQAHSSYFVADPNAPQNGRSGGASTREKELVSSLFCKLAQLIRQK
SEQ ID NO:60   VDEAHQYILEFDGGS---RSKGEHFPYEQEIKFFKNHRLYFLSAASRPLCTG-GHASNKEKEMVTSLFCKLGVLVRHR
SEQ ID NO:61   VDEAHQYILEFDGGS---RSKGEHFPYEQEIKFFKNHRLYFLSAASRPLCSG-GHASNKEKEMVTSLFCKLGVLVRHR
SEQ ID NO:62   VDEAHQYILEFDGGS---RGKGEHFPYEQEIKFFKNHRLYFLSAASRPLCSG-GHASNKEKEMVTSLFCKLGVLVRHR
```

FIGURE 1T

```
SEQ ID NO:2    LAAFGPDVRITVRCLQVLVRGIDAKSLVKNCPEFIRTSMLTFFNNVADDVGHTIMNLQDG-KYAHLR-GTHLKTSTSLGYIHGVLLPILT
SEQ ID NO:128  LAAFGPDVRITVRCLQVLVKGIDAKSLVKNCPEFIRTSMLTFFNNVADDVGHTIMNLQDG-KYAHLR-GTHLKTSTSLGYINGVLLPILT
SEQ ID NO:130  LAAFGPDVRITVRCLQVLVKGIDAKSLVKNCPEFIRTSMLTFFNNVADDVGHTIMNLQDG-KYAHLR-GTHLKTSTSLGYINGVLLPLLT
SEQ ID NO:144  LAAFGPDVRITVRCLQVLVKGIDAKSLVKNCPEFIRTSMLTFFNNVADDVGHTIMNLQDG-KYAHLR-GTHLKTSTSLGYINGVLLPILT
SEQ ID NO:146  LAAFGPDVRITVRCLQVLVKGIDAKSLVKNCPEFIRTSMLTFFNNVADDVGHTIMNLQDG-KYAHLR-GTHLKTSTSLGYINGVLLPILT
SEQ ID NO:4    LMAFGADVRITVRCLQVLVKAIDAKSLVKNCPEFIRTSMLTFFHNIADDLEHTIQNLHDS-RYCYLR-GTHLKTSTSLFYVNDVILPVLS
SEQ ID NO:6    LMAFGADVRITVRCLQVLVKAIDAKSLVKNCPEFIRTSMLTFFHNIADDLEHTIQNLHDS-RYCYLR-GTHLKTSTSLFYVNDVILPVLS
SEQ ID NO:8    LAAFGADVRISVKCLQVLVRGIDAKSLVKNCPEFIRTSMLTFFNNTADDLGHTIQNLQEG-KYSHLR-GAHLKTSTSLFYINDVILPVLT
SEQ ID NO:10   LSAFGPDVRITVRCLQVLVKGIDARTLTKNCPEFIRTSMLTFFNQTSDDLGNTILNLQDG-KYSHLR-GTHLKTSTSLGYVNQVLPVLT
SEQ ID NO:56   LSAFGPDVRITVRCLQVLVKGIDARTLTKNCPEFIRTSMLTFFNQTSDDLGNTILNLQDG-KYSHLR-GTHLKTSTSLGYVNQVLPVLT
SEQ ID NO:57   LAAFGADVRITVRCLQVLVKSIDAKSLVKNCPEFIRTSMLTFFNNTADDLGQTIVNLTDG-KYDRLR-GTHLKTSTSLAYVNQVILPVLT
SEQ ID NO:58   NRAFGSVAKITVKCLQGLTQALDLRTLVKVNSDIVRTSLLTFFNNCADDLYASVNELKDGGQYSLIR-GQALKSWNSFEFANQMIVPVLT
SEQ ID NO:59   INLFGRDLVPFIRCIRVVAQSIDASSVKHSADAIKNGLLVFFRHASDDLVATVDSVTSGGRFTHIKSNQVHKSLAVNYVPGVLVPVLI
SEQ ID NO:60   ISLFGNDATSIVNCLHILGQTLDARTVMKTGLDSVKSALRAFLDNAAEDLEKTMENLKQG-QFTHTR-SQPKGVTQIINYTTVALLPMLS
SEQ ID NO:61   ISLFGNDATSIVNCLHILGQTLDARTVMKTGLESVKSALRAFLDNAAEDLEKTMENLKQG-QFTHTR-NQPRGVTQIINYTTVALLPMLS
SEQ ID NO:62   ISLFGNDATSIVNCLHILGQTLDARTVMKTGLESVKSALRAFLDNAAEDLEKTMENLKQG-QFTHTR-NQPKGVTQIINYTTVALLPMLS

SEQ ID NO:2    AKFDHLANCEYGADLLLDEIQVASYKMLGSLYALGTDASLTHDRKYLKTEIERHKPALGSCLGAFSSTFPVAFQEPHLNKHNQFSLLNRI
SEQ ID NO:128  AKFDHLANCEYGADLLLDEIQVASYKMLGSLYALGTDASLTHDRKYLKTEIERHKPALGSCLGAFSSTFPVAFLEPHLNKHNQFSLLNRI
SEQ ID NO:130  AKFDHLANCEYGADLLLDEIQVASYKMLGSLYALGTDASLTHDRKYLKTEIERHKPALGSCLGAFSSTFPVAFLEPHLDKHNQFSLLNRI
SEQ ID NO:144  AKFDHLANCEYGADPLLDEIQVASYKMLGSLYALGTDASLTHDRKYLKTEIERHKPALGSCLGAFSSTFPVAFLEPHLDKHNQFSLLNRI
SEQ ID NO:146  AKFDHLANCEYGADLLLDEIQVASYKMLGSLYALGTDASLTHDRKYLKTEIERHKPALGSCLGAFSSTFPVAFLEPHLDKHNQFSLLNRI
SEQ ID NO:4    SLFDHLAAYEYGNELLLNEIQVAAYKMLSSLYTLGTDTSLTHDRKYLKVQLERHRPAFGSCLGAFSSTFPVAFLEPHLNKHNQYSLLNRF
SEQ ID NO:6    SLFDHLAAYEYGNELLLNEIQVAAYKMLSSLYTLGTDTSLTHDRKYLKVQLERHRPAFGSCLGAFSSTFPVAFLEPHLNKHNQYSLLNRF
SEQ ID NO:8    AMFDHLAACEYGSDLVLDEIQVASYKMLGSLYTLGIDVTLTHDRKYLKTEIDRHRPQLGRCLGAYASTFPVAFLEPHLNKHNQYSLVNRI
SEQ ID NO:10   AMFDHLAACDYGSDLLLDEIQVASYKILAALYHLGTDGTLTHDRKYLKTEIERHRPALGSCLGAYSSCFPVAFLEPHLNKHNQYSLLNRI
SEQ ID NO:56   AMFDHLAACDYGSDLLLDEIQVASYKILAALYHLGTDGTLTHDRKYLKTEIERHRPALGSCLGAYSSCFPVAFLEPHLNKHNQYSLLNRI
SEQ ID NO:57   SLFDHLAACDYGSDLLLDEIQVASYKILSALYTLGTDTSLTRDRKYLKTELERHKPALGSCLGAFSSCFPVAFLEPHANKHNPFSLLNRI
SEQ ID NO:58   TMFAHLARNHFGTDLLLDDIQAACYKILDSLYMVTGLSSSISHRKSISGESEKHRPGLGQCLAAFASCFPVAFLEPEFNKSNKFSVLAKS
SEQ ID NO:59   SLFQHLARHNYGADLLLDQIQVYCYRILSCLYKVGADQSI------Y--VKKLRPAVGELLAAFSGAFPVAFAGAFPIAFLETHLDKHNVYSIYNTR
SEQ ID NO:60   SLFEHIGQHQFGEDLILEDVQVSCYRILTSLYALGTSKSI------Y-----VERQRSALGECLAAFAGAFPVAFLETHLNKHNIYSIYNTK
SEQ ID NO:61   SLFEHIGQHQFGEDLILEDVQVSCYRILTSLYALGTSKSI------Y-----VERQRSALGECLAAFAGAFPVAFLETHLNKHNIYSIYNTK
SEQ ID NO:62   SLFEHIGQHQFGEDLILEDVQVSCYRILTSLYALGTSKSI------Y-----VERQRSALGECLAAFAGAFPVAFLETHLDKHNIYSIYNTK
```

FIGURE 1U

```
SEQ ID NO:2    ADHS---LEAQDIMQKMEQCMPTLETILGEVDQFVESDKTYNEAPHIIDVVLPLLCSYLPFWAQGPDNVTPTGGN-----HVTMVTAEH
SEQ ID NO:128  ADHS---LEAQDIMQKMEQCMPTLETILGEVDQFVESDKTYNEAPHIIDVVLPLLCSYLPFWAQGPDNVTPTGGN-----HVTMVTAEH
SEQ ID NO:130  ADHS---LEAQDIMQKMEQCMPTLEAILGEVDQFVESDKTYNEAPHIIDVVLPLLCSYLPFWAQGPDNVTPTGGN-----HVTMVTAEH
SEQ ID NO:144  ADHS---LEAQDIMQKMEQCMPTLETILGEVDQFVESDKTYNEAPHIIDVVLPLLCSYLPFWAQGPDNVTPTGGN-----HVTMVTAEH
SEQ ID NO:146  ADHS---LEAQDIMQKMEQCMPTLETILGEVDQFVESDKTYNEAPHIIDVVLPLLCSYLPFWAQGPDNVTPTGGN-----HVTMVTAEH
SEQ ID NO:4    ADSS---LEAQDIMSRTEGTMPTLETVLNEVDQFIESEKTYTDAPHIIDVILPLLCSYLPYWAQGPDNVALTTGN-----HVTMVTSEH
SEQ ID NO:6    ADSS---LEAQDIMSRMEGTMPTLETVLNEVDQFVESEKTVADAPHIIDVILPLLCSYLPYWAQGPDNVALTTGN-----HVTMVTSEH
SEQ ID NO:8    ADSS---LEAQDILSRMESTMPTLDNILSEVDQFVESDKTHNDAPHIIDVIMPMLCSYLPVWNQGPDNVALTAGN-----YVTTVTSEH
SEQ ID NO:10   ADHS---LEAQDIMVKMESCMPNLETILAEVDQFVESDKTYNDAPHIIDVILPLLCAYLPFWSQGPDNVSPTSGN-----HVTMVTADH
SEQ ID NO:56   ADHS---LEAQDIMVKMESCMPNLETILAEVDQFVESDKTYNDAPHIIDVILPLLCAYLPFWSQGPDNVSPTSGN-----HVTMVTADH
SEQ ID NO:57   ADTS---LEAQDIMSKMESCMPTLESILSEVDQFVESEKTYQEAQHIIDVILPLLCSYLPFWNQGPDNVSPQSGN-----HVTMVTADH
SEQ ID NO:58   QDQS---VQVQEMLQNLSTHIPHLEKLLTDLETVANNNTMYSDVPNVYDVDLPLMCSYMAHWFSVGPDGKRDKEDQRASVVQTTSVSCDH
SEQ ID NO:59   ELRG-ATVEGKEELIKLAAGIPTLPAVVTEIDKMAMSGAKYDQAPHIIEVILPMLCSYLNYWQQGPDNICRRQGN-----YWTMVNSGN
SEQ ID NO:60   SSRERTALSLPANVEDVCPNIPSLEKLMTEIIELAESGIRYTQMPYMMEVVLPMLCSYMSRWWEHGPENHPERAEM-----CCTALNSEH
SEQ ID NO:61   SSRERAALSLPANVEDVCPNIPSLEKLMEEIVELAESGIRYTQMPHVMEVILPMLCSYMSRWWEHGPESNPGRAEM-----CCTALNSEH
SEQ ID NO:62   SSRERAALSLPTNVEDVCPNIPSLEKLMEEIVELAESGIRYTQMPHVMEVILPMLCSYMSRWWEHGPENNPERAEM-----CCTALNSEH

SEQ ID NO:2    MNQLLKNVLKLIKKNIGNENAPWMTRIATYTQQIIINSSEELLRDSFLPLAERVRKRTDNMFHKEESLRGFIKSSTDDTSQVESQIQEDW
SEQ ID NO:128  MNQLLKNVLKLIKKNIGNENAPWMTRIATYTQQIIINSSEELLRDSFLPLAERVRKRTDNMFHKEESLRGFIKSSTDDTSQVESQIQEDW
SEQ ID NO:130  MNQLLKNVLKLIKKNIGNENAPWMTRIATYTQQIIINSSEELLRDSFLPLAERVRKRTDNMFHKEESLRGFIKSSTDDTSQVESQIQEDW
SEQ ID NO:144  MNQLLKNVLKLIKKNIGNENAPWMTRIATYTQQIIINSSEELLRDSFLPLAERVRKRTDNMFHKEESLRGFIKSSTDDTSQVESQIQEDW
SEQ ID NO:146  MNQLLKNVLKLIKKNIGNENAPWMTRIATYTQQIIINSSEELLRDSFLPLAERVRKRTDNMFHKEESLRGFIKSSTDDTSQVESQIQEDW
SEQ ID NO:4    MNCLLKNVLKLIKKNIGNDNAPWMTQIAAYTQQIIINSSEELLKDPFLPLAERVKKRTETLYHKEESLRGFIKSSTDDTSQIEAQIQEDW
SEQ ID NO:6    MNCLLKNVLKLIKKNIGNDNAPWMTQIAAYTQQIIINSSEELLKDPFLPLAERVKKRTETLYHKEESLRGFIKSSTDDTSQIEAQIQEDW
SEQ ID NO:8    MNQLLKNVLKMIKKNIGNESAPWMTRIAAYTQQIIINSSEELLKDPFLPLAERVKKRTDAMFHKEESLRGFIKSASDDTSQIEAQIQEDW
SEQ ID NO:10   MNPLLRNVLKMIKKNIGNDNAPWMTRIAAYTQQIIINTSEELLKDPFLPLAERVKKRTENMLHKEDSMRGFIKSATDDTSQVETQLQEDW
SEQ ID NO:56   MNPLLRNVLKMIKKNIGNDNAPWMTRIAAYTQQIIINTSEELLKDPFLPLAERVKKRTENMLHKEDSMRGFIKSATDDTSQVETQLQEDW
SEQ ID NO:57   MNHLLKNVLKMIRKNIANENAPWMTRIATYTQQIIINSSEELLKDVFLPLAERVKKRCDSMFHKEESLRGFIKSSTDDTSQIEAQIQEDW
SEQ ID NO:58   INRIFNALLKMIRNHVGIENAPWLCRVNFFAVQIIQNVTSDPVREFVLPIAERLRRMSEKAYKEEEHMRTHPD-----D--ADEGTVAEDN
SEQ ID NO:59   LNNTLGNVLTLGNVLINNLGSENAPWMSRIAATAKPILNDAQPELLKTHFVPVIEKLEERTSKVFKAEEDLKKEYPMGGQEMEETEFAILEDY
SEQ ID NO:60   MNTLLGNILKIIYNNLGIDEGAWMKRLAVFSQPIINKVKPQLLKTHFLPLMEKLKKKAAMVSEEDHLKAEARG---DMSEAELLILDEF
SEQ ID NO:61   MNTLLGNILKIIYNNLGIDEGAWMKRLAVFSQPIINKVKPQLLKTHFLPLMEKLKKKAAMVSEEDHLKAEARG---DMSEAELLILDEF
SEQ ID NO:62   MNTLLGNILKIIYNNLGIDEGAWMKRLAVFSQPIINKVKPQLLKTHFLPLMEKLKKKAATVSEEDHLKAEARG---DMSEAELLILDEF
```

FIGURE 1V

```
SEQ ID NO:2    QLLVRDIYSFYPLLIKYVDLQRNHWLRNNVPEAEELYNHVAEIFNIWSKSQYFLKEEQNFISANEIDNMVLIMPTATRRV---TAVTDGT
SEQ ID NO:128  QLLVRDIYSFYPLLIKYVDLQRNHWLRNNVPEAEELYNHVAEIFNIWSKSQYFLKEEQNFISANEIDNMVLIMPTATRRV---TAVTDGT
SEQ ID NO:130  QLLVRDIYSFYPLLIKYVDLQRNHWLRNNVPEAEELYNHVAEIFNIWSKSQYFLKEEQNFISANEIDNMVLIMPTATRRV---TAVTDGT
SEQ ID NO:144  QLLVRDIYSFYPLLIKYVDLQRNHWLRNNVPEAEELYNHVAEIFNIWSKSQYFLKEEQNFISANEIDNMVLIMPTATRRV---TAVTDGT
SEQ ID NO:146  QLLVRDIYSFYPLLIKYVDLQRNHWLRNNVPEAEELYNHVAEIFNIWSKSQYFLKEEQNFISANEIDNMVLIMPTATRRV---TAVTDGT
SEQ ID NO:4    QLVVRDIYAFYPLLIKYVDLQRNHWLRNSISNAEDLYNHVSEIFNIWSKSQYFLREEQNFISANEIDNMILIMPTATRRS---AVISETS
SEQ ID NO:6    QLVVRDIYAFYPLLIKYVDLQRNHWLRNNISNAEDLYNHVSEIFNIWSKSQYFLREEQNFISANEIDNMILIMPTATRRS---AVISETS
SEQ ID NO:8    QLLVRDIYSFYPLLIKYVDLQRNHWLRNNISEAEDLYNHVAEIFNTWSKSQYFLKEEQNFISANEIDNMVLIMPTATRRS---AVVSDSA
SEQ ID NO:10   NLLVRDIYSFYPLLIKYVDLQRNHWLKDNIPEAEELYNHVAEIFNIWSKSQYFLKEEQNFISANEIDNMALIMPTATRR----SAISEGA
SEQ ID NO:56   NLLVRDIYSFYPLLIKYVDLQRNHWLKDNIPEAEELYNHVAEIFNIWSKSQYFLKEEQNFISANEIDNMALIMPTATRR----SAISEGA
SEQ ID NO:57   QLLVRDIYSFYPLLIKYVDLQRNHWLKDNVAEAEELYNYVAEIFNVWSKSQYFLKEEQNFISANEIDNMTLIMPTATRRS---AAVSGDM
SEQ ID NO:58   ARLVRDTYAFFPILMKYTDLHRAQWLKTPTWETDGVYENVAVIFRIWSQSQHFKREELNYVAQFEEDAAATGGDMKTG------KAA
SEQ ID NO:59   HLIIRDLYASYPLLIKFVDSQRSQWLKSPSIDAEKLYYKVASIFNSWARSANFRREEQNYVAQTEVDSSAALTSAMSKSGGGNGNFSYGG
SEQ ID NO:60   TTLARDLYAFYPLLIRFVDYNRAKWLKEPNPEAEELFRMVAEVFIYWSKSHNFKREEQNFVVQNEINNMSFLITDTKS------KMSKAA
SEQ ID NO:61   TTLARDLYAFYPLLIRFVDYNRAKWLKEPTPEAEELFRMVAEVFIYWSKSHNFKREEQNFVVQNEINNMSFLITDTKS------KMSKAA
SEQ ID NO:62   TTLARDLYAFYPLLIRFVDYNRAKWLKEPNPEAEELFRMVAEVFIYWSKSHNFKREEQNFVVQNEINNMSFLITDTKS------KMSKAA

SEQ ID NO:2    PQGGG--KKKKKKHRDKKRDKDKEVQASLMVACLKRLLPVGLNLFAGREQELVQHCKDRFLKVGTLKKMSEQDVAEFAKTQLTLPDKIDPA
SEQ ID NO:128  PQGGG--KKKKKKHRDKKRDKDKEVQASLMVACLKRLLPVGLNLFAGREQELVQHCKDRFLKVGTLKK-----MSEQDVAEFAKTQLTLPDKIDPA
SEQ ID NO:130  PQGGG--KKKKKKHRDKKRDKDKEVQASLMVACLKRLLPVGLNLFAGREQELVQHCKDRFLKVGTLKKMSEQDVAEFAKTQLTLPDKIDPA
SEQ ID NO:144  PQGGG--KKKKKKHRDKKRDKDKEVQASLMVACLKRLLPVGLNLFAGREQELVQHCKDRFLKVGTLKKMSEQDVAEFAKTQLTLPDKIDPA
SEQ ID NO:146  PQGGG--KKKKKKHRDKKRDKDKEVQASLMVACLKRLLPVGLNLFAGREQELVQHCKDRFLKK------MSEQDVAEFAKTQLTLPDKIDPA
SEQ ID NO:4    LG-GSTGKKKKKKKHRDKKRDKEKEIQASLMVACLKRLLPVGLNLFAGREQELVQHCKDRFLKR------MPDYDVIRFVKIQLTLPDKLDPA
SEQ ID NO:6    LG-GSSGKKKKKKKHRDKKRDKDKEIQASLMVACLKRLLPVGLNLFAGREQELVQHCKDRFLKK------MPDYDVIQFVKIQLTLPDKLDPA
SEQ ID NO:8    APPGGSGKKKKKKNREKKRDKDKELQASLMVACLKRLLPVGLNLFAGREQELVQHCKDRFLKK------MQDYEIVEFAKIQLTLPDKLDPG
SEQ ID NO:10   PAVGGKVKKKKKKNRDKKRDKDKEVQASLMVACLKRLLPVGLNLFAGREQELVIEFARNQLTLPDKLDPS
SEQ ID NO:56   PAVGGKVKKKKKKNRDKKRDKDKEVQASLMVACLKRLLPVGLNLFAGREQELVQHCKDRYLKK------MPEYDVIEFARNQLTLPDKLDPS
SEQ ID NO:57   PASGGKVKKKKKRSRDKKRDKDKEIQSSLMVACLKRLLPVGLNLFAGKEQELVQHCKDRYLKK------MPEYEVIEFARTQLTLPDKLDPA
SEQ ID NO:58   IAERK--KKRR---E-GQIKDKHAASIVIACLKRLLPVGLNVFGGRELDIVQQSKEKFIQK-------ETEEKIREFIKGLLEIPVKTDPT
SEQ ID NO:59   SLPGEP-PKLQSTAPKRPDGQHGSPPSLILAALKRLLPIGMNQYGAREQELVQQAKLMFGQK-------ETDKEVRDYLLQQLHLHEKEK-V
SEQ ID NO:60   ISDQER-KKMK------RKGDRYSMQTSLIVAALKRLLPIGLNICAPGDQELIALAKNRFSLK------DTEEEVRDIIRSNIHLQGKLE-D
SEQ ID NO:61   VSDQER-KKMK------RKGDRYSMQTSLIVAALKRLLPIGLNICAPGDQELIALAKNRFSLK------DTEDEVRDIIRNNIHLQGKLE-D
SEQ ID NO:62   VSDQER-KKMK------RKGDRYSMQTSLIVAALKRLLPIGLNICAPGDQELIALAKNRFSLK------DTEDEVRDIIRSNIHLQGKLE-D
```

FIGURE 1W

```
SEQ ID NO:2    DEMSWQHYLYSKLGSKSK----------------------------------------SNITVETA----------------------------ENKAKIIDDTVERIV
SEQ ID NO:128  DEMSWQHYLYSKLGSKSK----------------------------------------SNITVETA----------------------------ENKAKIIDDTVERIV
SEQ ID NO:130  DEMSWQHYLYSKLGSKSK----------------------------------------SNITVETA----------------------------ENKAKIIDDTVERIV
SEQ ID NO:144  DEMSWQHYLYSKLGSKSK----------------------------------------SNITVETA----------------------------ENKAKIIDDTVERIV
SEQ ID NO:146  DEMSWQHYLYSKLGSKSK----------------------------------------SNITVETA----------------------------ENKAKIIDDTVERIV
SEQ ID NO:4    DEMSWQHYLYSKLGSKKG--------------------------------------------TPEIK-------------------------PQQVDEVADRIV
SEQ ID NO:6    DEMSWQHYLYSKLGSKKG--------------------------------------------NTEIK-------------------------PQQVDEVADRIV
SEQ ID NO:8    DEMSWQHYLYSTLGSKKE--------------------------------------------ITEGGK------------------------PEQIDAVVDRIV
SEQ ID NO:10   DEMSWQHYLYSKLGKTEEP-------------------------------------VDEQALEKANVNS-----------------------NEKGKDKTQETVDRIV
SEQ ID NO:56   DEMSWQHYLYSKLGKTEEP-------------------------------------VDEQALEKANVNS-----------------------NEKGKDKTQETVDRIV
SEQ ID NO:57   DEMSWQHYLYSKLGKKEQ--------------------------------------IVQDTLEKS---------------------------DKKPENKIEDTVERIV
SEQ ID NO:58   DKNAWQLSLYRKIGKSQMR-------------------------------------------------------------------------GKDEMSQDAVIEKIF
SEQ ID NO:59   EETARLTALGHAQSSISPKPSVSFSSSPPSSSSPASAPALATSSSSATSTTSTSSSSSSSSPSSVDPQDSTKPSRIRTRRQ
SEQ ID NO:60   PAIRWQMALYKDFPNRT---------------------------------------------------------------------------EDPSDPERTVERVL
SEQ ID NO:61   PAIRWQMALYKDLPNRT---------------------------------------------------------------------------EETSDPEKTVERVL
SEQ ID NO:62   PAIRWQMALYKDLPNRT---------------------------------------------------------------------------DDTSDPEKTVERVL

SEQ ID NO:2    AMSK---------VLFGLHMI---------------------------------------------------DHPQQMSKNVYRSVVSIQRKRAVI
SEQ ID NO:128  AMSK---------VLFGLHMI---------------------------------------------------DHPQQMSKNVYRSVVSIQRKRAVI
SEQ ID NO:130  AMSK---------VLFGLHMI---------------------------------------------------DHPQQMSKNVYRSVVSIQRKRAVI
SEQ ID NO:144  AMSK---------VLFGLHMI---------------------------------------------------DHPQQMSKNVYRSVVSIQRKRAVI
SEQ ID NO:146  AMSK---------VLFGLHMI---------------------------------------------------DHPQQMSKNVYRSVVSIQRKRAVI
SEQ ID NO:4    AMAK---------VLYGLHMI---------------------------------------------------DHPQLQSKAIYRSVVSTQRKRAVI
SEQ ID NO:6    AMAK---------VLFGLHMI---------------------------------------------------DHPQLQSKATYRSVVSTQRKRAVI
SEQ ID NO:8    AMAK---------VLFGLHMI---------------------------------------------------DHPQLQSKASYRSVVSTQRKRAVI
SEQ ID NO:10   AMAK---------VLFGLHMI---------------------------------------------------DHPQQQSKNVYRSVVSIQRKRAVI
SEQ ID NO:56   AMAK---------VLFGLHMI---------------------------------------------------DHPQQQSKNVYRSVVSIQRKRAVI
SEQ ID NO:57   AMAK---------VLYGLHM----------------------------------------------------DHPQQSKNVYRSVVSIQRKRAVI
SEQ ID NO:58   NMGQ---------VSAILHT----------------MTSRMEKEDIWKKVLTLQRKRMAI
SEQ ID NO:59   SIAAWQTAASRVTGAHITQSDSKGWQRHLYNNMAASKLVQVVELTKDKVIERIMNMAQVLNRLHQMEHPSMSKKNAWRRLMSAQRKRAIM
SEQ ID NO:60   GIAN---------VLFHLEQK-SKYTGRGYFS-----------------------------------------LVEHPQRSKKAVWHKLLSKQRKRAVV
SEQ ID NO:61   DIAN---------VLFHLEQK-SKFIGRRYYN-----------------------------------------LVEHPQRSKKAVWHKLLSKQRKRAVV
SEQ ID NO:62   DIAN---------VLFHLEQK-SKRVGRRHYC-----------------------------------------LVEHPQRSKKAVWHKLLSKQRKRAVV
```

FIGURE 1X

```
SEQ ID NO:2     ACFRQTSLHSLPRHRACNIFARTYYELWLEEENI-RQEVMIEDLTQSFEDAE--------------------------LKKSDVVEEGEKPDPLTQLVTTS
SEQ ID NO:128   ACFRQTSLHSLPRHRACNIFARTYYELWLEEENI-GQEVMIEDLTQSFEDAE--------------------------LKKSDVVEEGEKPDPLTQLVTTF
SEQ ID NO:130   ACFRQTSLHSLPRHRACNIFARTYYELWLEEENI-GQEVMIEDLTQSFEDAE--------------------------LKKSDVVEEGEKPDPLTQLVTTF
SEQ ID NO:144   ACFRQTSLHSLPRHRACNIFARTYYELWLEEENI-GQEVMIEDLTQSFEDAE--------------------------LKKSDVVEEGEKPDPLTQLVTTF
SEQ ID NO:146   ACFRQTSLHSLPRHRACNIFARTYYELWLEEENI-GQEVMIEDLTQSFEDAE--------------------------LKKSDVVEEGEKPDPLTQLVTTF
SEQ ID NO:4     ACFRQLSLHALTRHRAVNIFVRSFYELWLQDENI-GQEVVIEDLTQSFEEAE--------------------------LKKRDKEEEGMADPLNQMVTTF
SEQ ID NO:6     ACFRQLSLHALTRHRAVNIFVRSFYELWLQDENI-GQEVMIEDLTQSFEEAE--------------------------LKKRDKEEEGMADPLNQMVTTF
SEQ ID NO:8     ACFRQLSLHALPRHKAINIFARSYYELWLTEENV-GTEVLIEDLTQSFEDAE--------------------------LKKTDEEVDEGKSDPLTQLVTTF
SEQ ID NO:10    ACFRQTSLHSLPRHRACNIFARSYYEQWLQEENV-GQEVMVEDLTQTFEDSE--------------------------KSKKEGEETDSKPDPLTQLVTTF
SEQ ID NO:56    ACFRQTSLHSLPRHRACNIFARSYYEQWLQEENV-GQEVMVEDLTQTFEDSE--------------------------KSKKEGEETDSKPDPLTQLVTTF
SEQ ID NO:57    ----------------------------------------------------------------------------------------------------
SEQ ID NO:58    SLITASHLYKTELHRGINFFLPAFSRLWMEEEDA-GQDQLIADICSGVEEEGPRIEIIMEEGVPIVASSEDTKEKETNPDPLKQLIRCF
SEQ ID NO:59    ACFRMIPLHHLPRHRAINFFLKAYKERWLSNEES-AQHLLIDDLTKCSSE---------------------------ELQEFEPENVKDPLYQLISTF
SEQ ID NO:60    ACFRMAPLYNLPRHRAVNLFLQGYEKSWIETEEHYFEDKLIEDLAKPGAE---------------------------LPEEDEAMKRVDPLHQLILLF
SEQ ID NO:61    ACFRMAPLYNLPRHRAVNLFLQGYEKSWIETEEHYFEDKLIEDLAKPGAE---------------------------PPEEDEVTKRVDPLHQLILLF
SEQ ID NO:62    ACFRMAPLYNLPRHRAVNLFLQGYEKSWIETEEHYFEDKLIEDLAKPGAE---------------------------PPEEDEGTKRVDPLHQLILLF

SEQ ID NO:2     CRGAMTERSGA--LQEDPLYMSYAHIIAKSCGEEEEGGGEAEAEDEGRASIHEQEMEKQKLLFHQARPADRGVAEMVLLHIS
SEQ ID NO:128   CRGAMTERSGA--LQEDPLYMSYAHIIAKSCGEEEEGGGEAEAEDEGRASIHEQEMEKQKLLFHQARLADRGVAEMVLLHIS
SEQ ID NO:130   CRGAMTERSGA--LQEDPLYMSYAHIIAKSCGEEEEGGGEAEAEDEGRASIHEQEMEKQKLLFHQARLADRGVAEMVLLHIS
SEQ ID NO:144   CRGAMTERSGA--LQEDPLYMSYAHIIAKSCGEEEEGGGEAEAEDEGRASIHEQEMEKQKLLFHQARLADRGVAEMVLLHIS
SEQ ID NO:146   CRGAMTERSGA--LQEDPLYMSYAHIIAKSCGEEEEGGGEAEAEDEGRASIHEQEMEKQKLLFHQARLADRGVAEMVLLHIS
SEQ ID NO:4     CRGAMTERSGA--LQEDPLYMSYADILAKSCGEEEEGNNEEE--GSTGNGEEEGGASIHEQEMEKQKLLFHQARLANRGVAEMVLLHIS
SEQ ID NO:6     CRGAMTERSGA--LQEDPLYMSYADILAKSCGEEEEGNNEEE--GSNGNGDEEGGASIHEQEMEKQKLLFHQARLANRGVAEMVLLHIS
SEQ ID NO:8     CRGAMTERSGA--LQEDPLYMSYAEIAAKSCGEEEEGGGDEEE--EEQGASIHEQEMEKQKLLFHQSRLANRGVAEMVLLHIS
SEQ ID NO:10    CRGAMTERSGA--LQEDPLYMSYAQIAAKSTGKEEEGGDEE---GGEGEEAEG-TSIHEQEMEKQKLLFHQARLSNRGVAEMVLLHVS
SEQ ID NO:56    CRGAMTERSGA--LQEDPLYMSYAQIAAKSTGKEEEGGDEE---GGEGEGEG-TSIHEQEMEKQKLLFHQARLSNRGVAEMVLLHIS
SEQ ID NO:57    ------E------------------------------------------------QEMEKQKLLFHQARLSNRGVAEMVLLHIS
SEQ ID NO:58    QRAATSEETAASAIHEDSLYIRFADVMAKSIHIEEDGED--------GEGEIDQAAKEEQSQALRGEQAVLASRGAAIMCLMYLS
SEQ ID NO:59    SRAFGLQQ-DM--LEEDPLYLSYAAIMSTSCSGGEDDDDDDDD---G------GDENGTSFQEQEMEKQKLLSEQARLAERGCAEMVLLIS
SEQ ID NO:60    SRTALTEK-CK--LEEDFLYMAYADIMAKSCHDEEDD-----------------GEEEVKSFEEKEMEKQKLLYQQARLHDRGAAEMVLQTIS
SEQ ID NO:61    SRTALTEK-CK--LEEDFLYMAYADIMAKSCHDEEDD-----------------GEEEVKSFEEKEMEKQKLLYQQARLHDRGAAEMVLQTIS
SEQ ID NO:62    SRTALTEK-CK--LEEDFLYMAYADIMAKSCHDEEDD-----------------GEEEVKSFEEKEMEKQKLLYQQARLHDRGAAEMVLQTIS
```

FIGURE 1Y

```
SEQ ID NO:2     ASKGLPSEMVMKTLQLGISILRGGNIDIQMGMLNHLKDKKDVGFFTSIAGLMNSCSVLDLAFERNTKAEGLGVGLEGAA------GEKD
SEQ ID NO:128   ASKGLPSEMVMKTLQLGISILRGGNIDIQMGMLNHLKDKKDVGFFTSIAGLMNSCSVLDLAFERNTKAEGLGVGLEGAA-----GEKD
SEQ ID NO:130   ASKGLPSEMVMKTLQLGISILRGGNIDIQMGMLNHLKDKKDVGFFTSIAGLMNSCSVLDLAFERNTKAEGLGVGLEGAA----GEKD
SEQ ID NO:144   ASKGLPSEMVMKTLQLGISILRGGNIDIQMGMLNHLKDKKDVGFFTSIAGLMNSCSVLDLAFERNTKAEGLGVGLEGAA----GEKD
SEQ ID NO:146   ASKGLPSEMVMKTLQLGISILRGGNIDIQMGMLNHLKDKKDVGFFTSIAGLMNSCSVLDLAFERNTKAEGLGVGLEGAA----GEKD
SEQ ID NO:4     ACKGIPSEMVMKTLQLGIAVLRGGNLEIQMGMLNHLKEKKDVGFFTSVAGLMNSCSVLDLAFERNTKAEGLGVGSEGAA-----GEKD
SEQ ID NO:6     ACKGIPSEMVMKTLQLGIAVLRGGNLDIQMGMLNHLKEKKDVGFFTSVAGLMNSCSVLDLAFERNTKAEGLGVGSEGAA-----GEKD
SEQ ID NO:8     ACNGVPSDMVEKTLQLGISILRGGNIDIQMGMLNHLKEKKDVGFFTSIAGLMNSCSVLDLAFERNTKAEGLGVGSDGAA-----GEKD
SEQ ID NO:10    ASKGIPSEMVMTTLNLGIAILRGGNIDIQMGMLNHLKEKKDVGFFTSIAGLMNSCSVLDLAFERNTKAEGLGVGSEGAA-----GEKD
SEQ ID NO:56    ASKGIPSEMVMTTLNLGIAILRGGNIDIQMGMLNHLKEKKDVGFFTSIAGLMNSCSVLDLAFERNTKAEGLGVGSEGAA-----GEKD
SEQ ID NO:57    ASKGVPSEMVMRTLELGIAVLRGGNIDIQMGMLNHLKEKKDVGFFTSIAGLMNSCSVLDLAFERNTKAEGLGVGSDGAA-----GEKD
SEQ ID NO:58    ASGGEPNEMVAQTLQLGIHLLSGGNVEIQKMLIEYLQLKKDVRFFTSMAGLMNKCSVLNLMFERQIKAEGLMGAELASG-----DNQE
SEQ ID NO:59    ASKGEPSDMVFCSLKLGISLLRGGNEMVQRKMLEHLQDKMDVGFFTSVAELMEKCTVLDLAFERYNKAEGLGVTSGENAGCDGLRAGEKE
SEQ ID NO:60    ASKGETGPMVAATLKLGIAILNGGNSTVQQKMLDYLKEKKDVGFFQSLAGLMQSCSVLDLAFERQNKAEGLGMVTEEGS-----GEKN
SEQ ID NO:61    ASKGETGPMVAATLKLGIAILNGGNSTVQQKMLDYLKEKKDVGFFQSLAGLMQSCSVLDLAFERQNKAEGLGMVTEEGS-----GEKN
SEQ ID NO:62    ASKGETGPMVAATLKLGIAILNGGNSTVQQKMLDYLKEKKDVGFFQSLAGLMQSCSVLDLAFERQNKAEGLGMVTEEGS-----GEKN

SEQ ID NO:2     NMHDAEFTCALFRFIQLTCEGHNLDWQNYLRTQAGNTTTVNVICTVDYLLRLQESIMDFYWHYSSKELIDPAGKANFFKAIGVASQVFN
SEQ ID NO:128   NMHDAEFTCALFRFIQLTCEGHNLDWQNYLRTQAGNTTTVNVICTVDYLLRLQESIMDFYWHYSSKELIDPAGKANFFKAIGVASQVFN
SEQ ID NO:130   NMHDAEFTCALFRFIQLTCEGHNLDWQNYLRTQAGNTTTVNVICTVDYLLRLQESIMDFYWHYSSKELIDPAGKANFFKAIGVASQVFN
SEQ ID NO:144   NMHDAEFTCALFRFIQLTCEGHNLDWQNYLRTQAGNTAAVNVVICTVDYLLRLQESIMDFYWHYSSKELIDPAGKANFFKAIGVASQVFN
SEQ ID NO:146   NMHDAEFTCALFRFIQLTCEGHNLDWQNYLRTQAGNTTTVNVICTVDYLLRLQESIMDFYWHYSSKELIDPAGKANFFKAIGVASQVFN
SEQ ID NO:4     NMHDAEFTCTLFRFIQLTCEGHNLEWQNCLRTQAGNTTTVNVAICTVDYLLRLQESIMDFYWHYSSKELIDPAGKANFFKAIGVASLVFN
SEQ ID NO:6     NMHDAEFTCTLFRFIQLTCEGHNLEWQNYLRTQAGNTTTVNVICTVDYLLRLQESIMDFYWHYSSKELIDPAGKANFFKAIGVASQVFN
SEQ ID NO:8     NMHDAEFTCALFRFIQLTCEGHNLEWQNYLRTQAGNTTTVNVICTVDYLLRLQESIMDFYWHYSSKELIDPAGKANFFKAIEVASQVFN
SEQ ID NO:10    NMHDAEFTCALFRFIQLTCEGHNLDWQNYLRTQAGNTTTVNVICTVDYLLRLQESIMDFYWHYSSKELIDPAGKANFFKAIEVASQVFN
SEQ ID NO:56    NMHDAEFTCALFRFIQLTCEGHNLDWQNYLRTQAGNTTTVNVICTVDYLLRLQESIMDFYWHYSSKEIIDPAGKANFFKAIEVASQVFN
SEQ ID NO:57    NMHDAEFTCALFRFIQLTCEGHNLEFQNYLRTQPGHTTSVNLINCTVDYLLRLQESVMDFYWHYSSKEVIDEGGKEYFLRAIQCSQVFN
SEQ ID NO:58    NLNDADFTCSLFRFLQLTCEGHNLEFQNYLRTQAGNHTTVNIIICTVDYLLRLQESISDFYWYYSGKDVVDAQGRENFSRAFKVVKQVFS
SEQ ID NO:59    AMHDAEFTCALFRFLQLLCEGHNLEFQNYLRTQTGNNTTVNIISTVDYLLRLQESISDFYWYYSGKDIIDEQGQRNFSKAIQVAKQVFN
SEQ ID NO:60    VLQDDEFTCDLFRFLQLLCEGHNSDFQNYLRTQTGNNTTVNIISTVDYLLRLRVQESISDFYWYYSGKDVIDEQGQRNFSKAIQVAKQVFN
SEQ ID NO:61    VLQDDEFTCDLFRFLQLLCEGHNSDFQNYLRTQTGNNTTVNIISTVDYLLRLRVQESISDFYWYYSGKDVIDEQGQRNFSKAIQVAKQVFN
SEQ ID NO:62    VLQDDEFTCDLFRFLQLLCEGHNSDFQNYLRTQTGNNTTVNIISTVDYLLRLRVQESISDFYWYYSGKDVIDEQGQRNFSKAIQVAKQVFN
```

FIGURE 1Z

| SEQ ID | Sequence |
|---|---|
| SEQ ID NO:2   | TLTEVIQGPCTQNQQALAHSRLWDAVGGFLFLFSHMQDKLSKHSSQVDLLKELLNPQKDMITMMLSMLEGNVVNGTIVKQMVDTLVGSAS |
| SEQ ID NO:128 | TLTEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:130 | TLTEVIQGPCTQNQQALAHSRLWDAVGGFLFLFSHMQDKLSKHSSQVDLLKELLNLQKDMIPMMLSMLEGNVVNGTIGKQMVDTLVESAS |
| SEQ ID NO:144 | TLTEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:146 | TLTEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:4   | TLSEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:6   | TLSEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:8   | TLSEVIQGACTQNQQALAHSKLWDAVGGFLFLFSHMQDKLSKHSSQVDLLKELLNLQKDMITMMLSMLEGNVVNGTIGKQMVDTLVESAS |
| SEQ ID NO:10  | TLTEVIQGPCTLNQQALAHSRLWDAVGGFLFLFSHMQDKLSKHSSQVDLLKELLNLQKDMITMMLSMLEGNVVNGTIGKQMVDTLVESAS |
| SEQ ID NO:56  | TLTEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:57  | TLTEVIQGPCTQNQQALAHSRLWDAVGGFLFLFSHMQDKLSKHSSQVDLLKELLNLQKDMITMMLSMLEGNVVNGTIGKQMVDTLVESAS |
| SEQ ID NO:58  | TLTESIQGPCVGNQMTLANSRLWDAINGFFFLFAHMMEKLYKNSTQLELLREFLNLQKDMIVLMLSMLEGNVLNGSIGKQMVDALVESQP |
| SEQ ID NO:59  | SLTEYIQGPCSGNQLALAHSRLWDAVVGFLHIFANLQKKLSQDTSQLELLRDLLNLHKEMVVMLLSMLEGNVMHGTTGKQMVDTLVESSS |
| SEQ ID NO:60  | TLTEYIQGPCTGNQQSLAHSRLWDAVVGFLHVFAHMQMKLSQDSSQIELLKELMDLQKDMVVMLLSMLEGNVVNGTIGKQMVDMLVESSN |
| SEQ ID NO:61  | TLTEYIQGPCTGNQQSLAHSRLWDAVVGFLHVFAHMQMKLSQDSSQIELLKELMELQKDMVVMLLSMLEGNVVNGTIGKQMVDMLVESSN |
| SEQ ID NO:62  | TLTEYIQGPCTGNQQSLAHSRLWDAVVGFLHVFAHMQMKLSQDSSQIELLKELMDLQKDMVVMLLSMLEGNVVNGTIGKQMVDMLVESSN |

| SEQ ID | Sequence |
|---|---|
| SEQ ID NO:2   | NVELILKYFDMFLKLKDLTSSASFQEIDANNDGWVLPKDFKEKMEQQKSYTPEEIEFLLACCETNHDGKLDYIGFCDRFHEPAKEIGFNL |
| SEQ ID NO:128 | NVELILKYFDMFLKLKDLTSSASFQEIDANNDGWVLPKDFKEKMEQQKSYTPEEIEFLLACCETNHDGKLDYIGFCDRFHEPAKEIGFNL |
| SEQ ID NO:130 | NVELILKYFDMFLKLKDLTSSASFQEIDANNDGWVLPKDFKEKMEQQKSYTPEEIEFLLACCETNHDGKLDYIGFCDRFHEPAKEIGFNL |
| SEQ ID NO:144 | NVELILKYFDMFLKLKDLTSSASFQEIDANNDGWVLPKDFKEKMEQQKSYTPEEIEFLLACCETNHDGKLDYIGFCDRFHEPAKEIGFNL |
| SEQ ID NO:146 | NVELILKYFDMFLKLKDLTSSASFQEIDANNDGWVLPKDFKEKMEQQKSYTPEEIEFLLACCETNHDGKLDYIGFCDRFHEPAKEIGFNL |
| SEQ ID NO:4   | NVELILKYFDMFLKLKDLTSSTSFTEIDPNNDGWVHPKDFKEKMEQQKSYTAEEIEFMLQCCESNHDGKIDYIGFTDQFHEPSKEIGFNL |
| SEQ ID NO:6   | NVELILKYFDMFLKLKDLTSSTSFTEIDPNNDGWVHPKDFKEKMEQQKSYTAEEIEFMLQCCESNHDGKIDYIGFTDQFHEPSKEIGFNL |
| SEQ ID NO:8   | NVELILKYFDMFLKLKDLTSSTSFTEIDPNNDGWVHPKDFKEKMEQQKSYTAEBIEFMLQCCESNHDGKIDYIGFTDQFHEPSKEIGFNL |
| SEQ ID NO:10  | NVELILKYFDMFLKLKDLTSSTSFLEIDPNHDGWVLPKDFREKMEQQKSYTEEISFMLQCCETNHDGKVDYIGFVDRFHEPSKEIGFNL |
| SEQ ID NO:56  | NVELILKYFDMFLKLKDLTSSTPSFMEIDSNGDGWIMPKDFREKMEQQKSYTPEEMDFLLACCERNHEGKIDYRAFVEHFHEPSKEIGFNL |
| SEQ ID NO:57  | NVELILKYFDMFLKLKDLTSTPSFMEIDSNGDGWIMPKDFREKMEQQKSYTPEEMDFLLACCERNHEGKIDYRAFVEHFHEPSKEIGFNL |
| SEQ ID NO:58  | NVELILKYFDMFLKLKDLTSSTPSFMEIDSNGDGWIMPKDFREKMEQQKSYTPEEIDFLLACCETNHDGKIDYIGFVDRFHEPAKEIGFNL |
| SEQ ID NO:59  | SVEKILKFSDMFLKLKDLTTSQAFQDFTNQDGWISPKEFQRAMESQKMYTVEDITYLMCTDVNNDGKVDYMEFTERFHNPARDIGFNL |
| SEQ ID NO:60  | NLEMILKFFDMFLKLKDLSSSDAFREFDANGDGWISHKEFQKAMEAQKMYTVDEIDYLLKCADRNNDGRIDFNEFTERFHGPAQDIGFNL |
| SEQ ID NO:61  | NVEMILKFFDMFLKLKDLTSSDTFKEYDPDGKGIISKRDFHKAMESHKHYTQSETEFLLSCAETDENETLDYEEFVKRFHEPAKDIGFNV |
| SEQ ID NO:62  | NVEMILKFFDMFLKLKDLTSSDTFKEYDPDGKGVISKRDFHKAMESHKHYTQSETEFLLSCAETDENETLDYEEFVKRFHEPAKDIGFNV |

FIGURE 1AA

```
SEQ ID NO:2     AVLLTNLSEHMPNEPRLARFLETAGSVLDYFEPFLGRIEIMGGSKRIERVYFEIKESNIEQWEKPQIKESKRAFFYSIVTE-GGDREKLE
SEQ ID NO:128   AVLLTNLSEHMPNEPRLARFLETAGSVLNYFEPFLGRIEIMGGSKRIERVYFEIKESNIEQWEKPQIKESKRAFFYSIVTE-GGDKEKLE
SEQ ID NO:130   AVLLTNLSEHMPNEPRLARFLETAGSVLNYFEPFLGRIEIMGGSKRIERVYFEIKESNIEQWEKPQIKESKRAFFYSIVTE-GGDKEKLE
SEQ ID NO:144   AVLLTNLSEHMPNEPRLARFLETAGSVLNYFEPFLGRIEIMGGSKRIERVYFEIKESNIEQWEKPQIKESKRAFFYSIVTE-GGDKEKLE
SEQ ID NO:146   AVLLTNLSEHMPNEPRLARFLETAGSVLNYFEPFLGRIEIMGGSKRIERVYFEIKESNIEQWEKPQIKESKRAFFYSIVTE-GGDKEKLE
SEQ ID NO:4     AVLLTNLSEHMPNEPRLTRFLETASSVLNYFQPFLGRIEILGGSKRIERVYFEIKESNIEQWLKPQIRESKRAFFYSIVTE-GGDKEKLE
SEQ ID NO:6     AVLLTNLSEHMPNEPRLTRFLETASSVLNYFQPFLGRIEILGGSKRIERVYFEIKESNIEQWLKPQIRESKRAFFYSIVTE-GGDKEKLE
SEQ ID NO:8     AVLLTNLSEHMPNEPRLARFLETAGSVLNYFEPFLGRIEIMGSSKRIERVYFEIKDSNIEQWEKPQIRESKRAFFYSIVTE-GGDKEKLE
SEQ ID NO:10    AVLLTNLSEHMPNEPRLARFLETAGSVLNYFEPFLGRIEILGSSKRIERVYFEIKDSNIEQWEKPQIRESKRAFFYSIVTE-GGDKEKLE
SEQ ID NO:56    AVLLTNLSEHMPNEPRLARFLETAGSVLNYFEPFLGRIEILGSSKRIERVYFEIKDSNIEQWEKPQIKESKRAFFYSIVTE-GGDKEKLE
SEQ ID NO:57    AVLLTNLSEHMPNEPRLARFLETAGSVLNYFESFLGRIEIMGSSKRIERVYFEIKEANIEQWEKPQIKESKRAFFYSIVTE-GGDKEKLE
SEQ ID NO:58    AVILVNLKEHITNDPRLEKITEKAQTLLEYFDPFLGRIEIMGSSKRVEKIYFEIQESWLEQWGKQQIRDSKNSFLFNVLQDDGDQGKLE
SEQ ID NO:59    AVLLTNLNDHMPGERRLERFLLQAESLLTYFEPYLGRIEIMGSSRGIERVYFKITESHKAQWEKPQIKESKQQFLHEVVNE-GGEKEKLE
SEQ ID NO:60    AVLLTNLSEHMPNDTRLQTFLELAESVLNYFQPFLGRIEIMGSAKRIERVYFEISESSRTQWEKPQVKESKRQFIFDVVNE-GGEKEKME
SEQ ID NO:61    AVLLTNLSEHMPNETRLQTFLELAESVLNYFQPFLGRIEIMGSAKRIERVYFEISESSRTQWEKPQVKESKRQFIFDVVNE-GGEKEKME
SEQ ID NO:62    AVLLTNLSEHMPNDTRLQTFLELAESVLNYFQPFLGRIEIMGSAKRIERVYFEISESSRTQWEKPQVKESKRQFIFDVVNE-GGEKEKME

SEQ ID NO:2     AFVNFCEDAIFEMTHASGLMAASEES-VGGTKNREASYM-YMGDDGDERAGKDPFRRGLQSVKDGVATAFSSLSPSNIKAKIADMQQMPP
SEQ ID NO:128   AFVNFCEDAIFEMTHASGLMAASEES-VGGTKNREASYM-YMGDDDDERAGKDPFRRGLQSVKDGVATAFSSLSPSNIKAKIADMQQMPP
SEQ ID NO:130   AFVNFCEDAIFEMTHASGLMAASEES-VGGTKNREASYM-YMGDDDDERAGKDPFRRGLQSVKDGVATAFSSLSPSNIKAKIADMQQMPP
SEQ ID NO:144   AFVNFCEDAIFEMTHASGLMAASEES-VGGTKNREASYM-YMGDDDDERAGKDPFRRGLQSVKDGVATAFSSLSPSNIKAKIADMQQMPP
SEQ ID NO:146   AFVNFCEDAIFEMTHASGLMAASEES-VGGTKNREASYM-YMGDDDDERAGKDPFRRGLQSVKDGVATAFSSLSPSNIKAKIADMQQMPP
SEQ ID NO:4     AFVNFCEDAIFEMQHASGLMAVDDGSGIGGGKSRKTSYT-YLADDEENKTAKDPIRRGIQAIKYGFHLLFFVLSPTNIKNKINEIQQMSV
SEQ ID NO:6     AFVNFCEDAIFEMQHASGLMAVDDGSGIGGGKSRKTAYI-YLADDEENKTAKDPIRRGIQAIKYGFQLLFFVLSPTNIKNKINEIQQMSF
SEQ ID NO:8     AFVNFCEDAIFEMTHASGLMSVDDDSGGGGGGK---GGNVKRDTAYSSYMSEEEERAARDPIRRTIQAFKDAIYFILTMLSPANIKHQIGVMQTKSI
SEQ ID NO:10    AFVNFCEDAIFEMTHASGLMATDDG---GGNVKRDTAYSSYMSEEEERAARDPIRRTITAVKEGLKFGVHMLSPANIKHQIGVMQTKSI
SEQ ID NO:56    AFVNFCEDAIFEMTHASGLMATDDG---GGNVKRDTAYSSYMSEEEERAARDPIRRTITAVKEGLKFGVHMLSPANIKHQIGVMQTKSI
SEQ ID NO:57    AFVNFCEDAIFEMTHASGLMASDDD---GGTVRRDQAFT-YISEEEEERAARDPIKRTIQAVKDGLSYSMYMISPNIKHQITVLQSKSF
SEQ ID NO:58    AFINFCEDTIFEMQHAAAISSGDSD---TKMERAIKQRDYFLQQTSADHISETFKSGYNYGISAASALSPQNISTTMRNVSSVRQMSW
SEQ ID NO:59    DFVNFCEDTIFEMQLAAQISDTGESL-PEVFMSLLTFGASRDSNNWLVWLVRGMRPSNICRLMGDFFSSSQYNIKQIRSLSLFRLFFGVI
SEQ ID NO:60    LFVNFCEDTIFEMQLAAQISESDLNE-RLANKEESEKERPEEQAPRMGFFSLLTIQSALFALRYNVLTLVRMLSLKKQMKRMKKMTV
SEQ ID NO:61    LFVNFCEDTIFEMQLAAQISESDLNE-RSANKEESEKERPEEQGPKMGFFSVLTVRSALFALRYNILTLMRMLSLKKQMKKMKKMTV
SEQ ID NO:62    LFVNFCEDTIFEMQLAAQISESDLNE-RSANKEESEKERPEEQGPRMAFFSILTVRSALFALRYNILTLMRMLSLKKQMKKVKKMTV
```

FIGURE 1BB

```
SEQ ID NO:2    AELAVGFFKMFFYPFYYLGYGVLVVVRYIFGVLLGLMRGPQTDEPPPEPTEEEKIG----------QLRHRLLATQSSR----------HLPALPPA
SEQ ID NO:128  AELAVGFFKMFFYLFYYLGYGVLVVVRYIFGVLLGLMRGPQTDEPPPEPTEEEKIG----------QLRHRLLATQSSR----------HLPALPPA
SEQ ID NO:130  AELAVGFFKMFFYLFYYLGYGVLVVVRYIFGVLLGLMRGPQTDEPPPEPTEEEKIG----------QLRHRLLATQSSR----------HLPALPPA
SEQ ID NO:144  AELAVGFFKMFFYLFYYLGYGVLVVVRYIFGVLLGLMRGPQTDEPPPEPTEEEKIG----------QLRHRLLATQSSR----------HLPALPPA
SEQ ID NO:146  AELAVGFFKMFFYLFYYLGYGVLVVVRYIFGVLLGLMRGPQTDEPPPEPTEEEKIG----------QLRHRLLATQSSR----------HLPALPPA
SEQ ID NO:4    IELITSFFKLWFYLIFYTGYSGVYVLRYISRILMQLMSGTQSEETTVEVVEEK-------------SGSFR-----------------MLPALPSS
SEQ ID NO:6    VELITSFFKLWFYLIFYTGYSGVYVLRYISRILMQLMSGTQSEETTVEVVEKR-------------AGSFR-----------------MLPALPSS
SEQ ID NO:8    PELVGFFKIFFYMFYYSGFSVSVVLRYFGRILMTLMRGPQTEEPVAEVKKEDEI------------MGPIR-----------------ALPPPPD
SEQ ID NO:10   PELIVGFFKIIFYIFYTGYAHFCVVRYIFGILLNLMRGPAPEQ-EEEPVVEEET------------FGR-------------------ALPPLSLE
SEQ ID NO:56   PELIVGFFKIIFYIFYTGYAHFCVVRYIFGILLNLMRGPAPEQ-EEEPVVEEET------------FGR-------------------ALPPLPLE
SEQ ID NO:57   PELIIVGFFKMIFYAFYYSGFGVSVVIKYLVNILMSLMRGPAQE--EEEPIPEAEP----------SLR-------------------ALPPLPLE
SEQ ID NO:58   TQLLYAVIILFIRAGLAIGWAGYLLLMTIFRFGYFLTTSSEEEAARQEKEQAKMN-----------N--EHPSFN--------------PPIIQE
SEQ ID NO:59   KLIFLGVFKLFKFAFVIVGKLIG-LLVGTRILEDAREITGSIKHSLHVPRVARRQT----SSIINVPGYGMPSARRNTSFWQYLTSQYFT
SEQ ID NO:60   KDMVLAFFSSYWSVFVTLLHFVASVCRGFFRIVSSLLLGGSLVEGAKKIKVAELLANMDPTQDEVRGDEEEGERK--PLESALPSEDLT
SEQ ID NO:61   KDMVTAFFSSYWSIFMTLLHFVASVFRGFFRIVCSLLLGGSLVEGAKKIKVAELLANMDPTQDEVRGDGEEGERK--PMETTLPSEDLT
SEQ ID NO:62   KDMVTAFFSSYWSIFMTLLHFVASVFRGFFRIICSLLLGGSLVEGAKKIKVAELLANMDPTQDEVRGDGEEGERK--PLEAALPSEDLT

SEQ ID NO:2    DDTGQMQVSAFGLDITKEDNGQ---------------IQVKPHESPSTSTPSSGGE-AEVSPDESADHTEE---------QRPPSLIDLLGGEQAKK
SEQ ID NO:128  DDTGQMQVSAFGLDITKEDNGQ---------------IQVKPHESPSTSTPSSGEE-AEVSPDESADHTEE---------QRPPSLIDLLGGEQAKK
SEQ ID NO:130  DDTGQMQVSAFGLDITKEDNGQ---------------IQVKPHESPSTSTPSSGEE-AEVSPDESADHTEE---------QRPPSLIDLLGGEQAKK
SEQ ID NO:144  DDTGQMQVSAFGLDITKEGNGQ---------------IQVKPHESPSTSTPSSGEE-AEVSPDESADHTEE---------QRPPSLIDLLGGEAAKK
SEQ ID NO:146  DDTGQMQVPAFGLDITKEDNGQ---------------IQVKPHESPSTSTPSSGEE-AEVSPDESADHTEE---------QRPPSLIDLLGGEQAKK
SEQ ID NO:4    GIDETPSTLTDSNNMRKNSGSL---------------DSKHLKSTTGGD--DKDETSAENHEKEDGVDG---------SELQASFVDLLVGESARK
SEQ ID NO:6    GVDEPPSTLIDSSNMRKNSGAP---------------DSKHVKSTTVGD--DKDETSTENHEKEDGVKSE--------DNSELQASFVDLLVGESARK
SEQ ID NO:8    NKEASSSSAKDDSGQAKPADG----------------GATLALTASGE--EHKEGGATEEGAEDGAKPEG--AETTEGTTMTLADLLGGEAARK
SEQ ID NO:10   EPPG--TVQAFGLDINKEENGM---------------YKVVVHESPAN---SSMEEGGESSPEDGAAASGELVEGEPHQGPISIVDLLGGEAAKK
SEQ ID NO:56   EPPG--TVQAFGLDINKEENGM---------------YKVVVHESPAN---SSMEEGGESSPEDGAAASGELVEGEPHQEPISIVDLLGGEAAKK
SEQ ID NO:57   EPPG--TVQAFGLDISKEENGQ---------------YRMAPHESPALSPSSIEETGESSPEDGAAELTG--EGVPPGEQMTLVDLLGGEAAKR
SEQ ID NO:58   FHHSHVGVTAFGVGMNADHLN----------------VNSLPDFVPPERPETPETVLEEEKPLN------------QETSPPTSPT
SEQ ID NO:59   NVNSMDTVSAFGIDFLKGKGGGGGGGAGGTDQYKLRMRKRRPLTPSSSFDFDEEMSMDNMPTHTPSEASD--SSFDSGAMAKNDFSMPD
SEQ ID NO:60   DLKELTEESDLLSDIFGLDLKREGG------------QYKLIPHNPNAGLSDLMTNPVPVPEVQEKFQEQKAKEE----KEEKEETKSEPEKAE
SEQ ID NO:61   DLKELTEESDLLSDIFGLDLKREGG------------QYKLIPHNPNAGLSDLMSNPVLIPEEQEKFQEQKTKEEE---KEEKEETKSEPEKAE
SEQ ID NO:62   DLKELTEESDLLSDIFGLDLKREGG------------QYKLIPHNPNAGLSDLMSNPVPMPEVQEKFQEQKAKEEE---KEEKEETKSEPEKAE
```

FIGURE 1CC

```
SEQ ID NO:2    QAQERMEAQAAQQAAMSAIEAESKKAVQG-PAPSALSQVDLSQYTRRAVSFLARNFYNLKYVALVLAFCINFVLLFYKVSTLDGEGGE--
SEQ ID NO:128  QAQERMEAQAAQQAAMSAIEAESKKAVQG-PAPSALSQVDLSQYTRRAVSFLARNFYNLKYVALVLAFCINFVLLFYKVSTLDGEGGE--
SEQ ID NO:130  QAQERMEAQAAQQAAMSAIEAESKKAVQG-PAPSALSQVDLSQYTRRAVSFLARNFYNLKYVALVLAFCINFVLLFYKVSTLDGEGGE--
SEQ ID NO:144  QAQERMEAQAAQQAAMSAIEAESKKAVQG-PAPSALSQVDLSQYTRRVVSFLARNFYNLKYVALVLAFCINFVLLFYKVSTLDGEGGE--
SEQ ID NO:146  QAQERMEAQAAQQAAMSAIEAESKKAVQG-PAPSALSQVDLSQYTRRAVSFLARNFYNLKYVALVLAFCINFILLFYKVTTLADDLSDDG
SEQ ID NO:4    DSIAGPEVLAQQQAVMAAVEAEIKQKNSV-ENPSAFSTIDINAYTHRALSFLARNFYNLKYVALVLAFCINFILLFYKVTTLADDLSDDG
SEQ ID NO:6    DSIAGPEVLAQQQAVMAAVEAEIKQKNSV-ENPSAFSTIDINAYTHRALSFLARNFYNLKYVALVLAFCINFILLFYKVTTLAEDLSDDG
SEQ ID NO:8    EAVARAEVAAEQQAVMAAVEAEAKHEVVS-E-PSAFSQIDFNRYTHRAVSFLARNFYNLKYVALVLAFCINFILLFYKVTTLGEDEDGG
SEQ ID NO:10   AAQERQEAQKAQEAMASIEAEAKKSSSAPQETPAVHQIDFSQYTHRAVSFLARNFYNLKYVALVLAFSINFMLLFYKVTSFTEEADS--
SEQ ID NO:56   AAQERQEAQKAQEAMASIEAEAKKSSSAPQETPAVHQIDFSQYTHRAVSFLARNFYNLKYVALVLAFSINFMLLFYKVTSFTEEADS--
SEQ ID NO:57   AAQERTEAQKAQEATLASIEAESKKASTETKEPAAVHQIDFSKYTKKCVSYLARNFYNLKYVALVLAFCINFMLLFYKVTTLGDDEDGEG
SEQ ID NO:58   SPASKAPSIYESIGAPQMVQLQSEADFQQGQYEPKIAESNSTKSRGSILNMLARNFKTIEKITLYLAFFINVILLFHRVD---------
SEQ ID NO:59   MSAGRRDSTVFP-SLFLATEMPSTQVKEEEEEEPVYEPQMNRVKQTVVSLFARNFYNIKYVALALVFCINLLLFFKVSYLTAELEE---
SEQ ID NO:60   GEDGEKEEKAKDEKSKQKLRQLHTHRYGEPEVPESAFWKKIIAYQQKLLNYFARNFYNMRMLALFVAFAINFILLFYKVS--TSSVVE-
SEQ ID NO:61   GEDGEKEEKVKEDKGKQKLRQLHTHRYGEPEVPESAFWKKIIAYQQKLLNYFARNFYNMRMLALFVAFAINFILLFYKVS--TSSVVE-
SEQ ID NO:62   GEDGEKEEKAKEDKGKQKLRQLHTHRYGEPEVPESAFWKKIIAYQQKLLNYFARNFYNMRMLALFVAFAINFILLFYKVS--TSSVVE-

SEQ ID NO:2    -----GSGLGDIIAGGGSGSGSGAGS------------GSGDGSGETGE--DDDALEVVHIDEDFFYMEHVIKMAAVLHSIVSLAILIGYYHLKV
SEQ ID NO:128  -----GSGLGDIIAGGGSGSGSGAGS------------GSGDGSGESGE--DDDALEVVHIDEDFFYMEHVIKMAAVLHSIVSLAILIGYYHLKV
SEQ ID NO:130  -----GSGLGDIIAGGGSGSGSGAGS------------GSGDGSGESGE--DDDALEVVHIDEDFFYMEHVIKMAAVLHSIVSLAILIGYYHLKV
SEQ ID NO:144  -----GSGLGDIIAGGGSGSGSGAGS------------GSGDGSGESGE--DDDALEVVHIDEDFFYMEHVIKMAAVLHSIVSLAILIGYYHLKV
SEQ ID NO:146  -----GSGLGDIIAGGGSGSGSGAGS------------GSGDGSGESGE--DDGALELVHVNEDFFYMAHVMRLAALLHSLASLAMLIAYYHLKV
SEQ ID NO:4    --------DVKEFALGSAGISNDDID-------------DSNSTEMAD--DDGALELVHVNEDFFYMAHVMRLAALLHSLASLAMLIAYYHLKV
SEQ ID NO:6    --------DSKDFALGSAGISNDDID-------------DSNSTEIAD--DDGALELVHVNEDFFYMAHVMRLAALLHSLASLAMLIAYYHLKV
SEQ ID NO:8    SGELGGGLAEDLLEELGGGSGGLSG-GISGGESGEDGSGE--EEDPIELVHVNEDFFYMEHVLRIAACLHSLVSLAMLIAYYHLKV
SEQ ID NO:10   -----SAEEELILGSGPGGGADITGSGFGGSGGDGSGDGE-MEDEIPELVHVHVDEDFFYMEHVLRIAACLHSLVSLAMLIAYYHLKV
SEQ ID NO:56   -----SAEEELILGSGSGGGADITGSGFGGSGGDGSGDGE-MEDEIPELVHVHVDEDFFYMEHVLRIAACLHSLVSLAMLIAYYHLKV
SEQ ID NO:57   -----GSGESLMGLGSGLGSGLGILETGSGG-GEGGSGDGEGEEDPPEKVHVDEDFFYMEHVLRIAAILHSLVSLCMLIAYYHLKV
SEQ ID NO:58   --------ISHAENAEAASEGD-----------DDEDALESIFITGMQFPYVEYEITGWMLAQILYWISVLHLSTSFALLVSFYQLKI
SEQ ID NO:59   --------VDPYHPVEILENATSPNG--------ADMAGDEDR--VDDQIEQILINQQFMYLVPVLQVLSILHSLVSISMLIAYCALKV
SEQ ID NO:60   --------GKELPTRTSSDTAKVTNS----------LDSSPHR------IIAVHYVLEESSGYMEPTLRILAILHTIISFFCIIGYYCLKV
SEQ ID NO:61   --------GKELPSRSTSENAKVTTS----------LDSSSHR------IIAVHYVLEESSGYMEPTLRILAILHTVISFFCIIGYYCLKV
SEQ ID NO:62   --------GKELPTRSSSENAKVTS-----------LDSSSHR------IIAVHYVLEESSGYMEPTLRILAILHTVISFFCIIGYYCLKV
```

FIGURE 1DD

```
SEQ ID NO:2     PLAIFKREKEIARKLEFDGLYIAEQPED------DDLKSHWDKLVISAKSFPVNYWDKFVKKKVRAKYSETYDFDSISNMLGMEKTSFSAQ
SEQ ID NO:128   PLAIFKREKEIARKLEFDGLYIAEQPED------DDLKSHWDKLVISAKSFPVNYWDKFVKKKVRAKYSETYDFDSISNMLGMEKTSFSAQ
SEQ ID NO:130   PLAIFKREKEIARKLEFDGLYIAEQPED------DDLKSHWDKLVISAKSFPVNYWDKFVKKKVRAKYSETYDFDSISNMLGMEKTSFSAQ
SEQ ID NO:144   PLAIFKREKEIARKLEFDGLYIAEQPED------DDLKSHWDKLVISAKSFPVNYWDKFVKKKVRAKYSETYDFDSISNMLGMEKTSFSAQ
SEQ ID NO:146   PLAIFKREKEIARKLEFDGLYIAERPED------DDLKSHWDKLVISAKSFPVNYWDKFVKKKVRAKYSETYDFDSISNMLGMEKTSFSAQ
SEQ ID NO:4     PLAIFKREKEIARRLEFDGLYIVEQPED------DIKSHWDKLVISAKSFPVNYWDKFAKKKVRQKYSETYDFDSISNLLGMEKTSFSTQ
SEQ ID NO:6     PLAIFKREKEIARRLEFDGLYIVEQPED------DDIKSHWDKLVISAKSFPVNYWDKFAKKKVRQKYSETYDFDSISNLLGMEKTSFSTQ
SEQ ID NO:8     PLAIFKREKEIARRLEFDGLYIAEQPED------DDIKSHWDKLVISAKSFPVNYWDKFVKKKVRQKYSETYDFDSISTLLGMEKTSFSSQ
SEQ ID NO:10    PLAIFKREKEIARRLEFEGLFIAEQPED------DDFKSHWDKLVISAKSFPVNYWDKFVKKKVRQKYSETYDFDSISNLLGMEKSTFAAQ
SEQ ID NO:56    PLAIFKREKEIARRLEFEGLFIAEQPED------DDFKSHWDKLVISAKSFPVNYWDKFVKKKVRQKYSETYDFDSISNLLGMEKSTFAAQ
SEQ ID NO:57    PLAIFKREKEIARKLEFDGLFIAEQPED------DDIKSHWDKLVISAKTFPVNYWDKFVKKKVRQKYSETYDFDSISNLLGMEKTAFAAQ
SEQ ID NO:58    PLITFKREKEIARKLMFDGCWITEEDSEELGIVDTFMWYLDRIVVSAKSFPMMYWDKFVRKTRSKFDQVDEETLTSIILGEEKMS---T
SEQ ID NO:59    PLCLFKREKEIARKLEFDGQWITEQPTR------DDIKGQWDSLAISTVSFPVYYWDKFVKKKVLKKYEDAVGEDKLCAMLGMEIGENPMA
SEQ ID NO:60    PLVIFKREKEVARKLEFDGLYITEQPSE------DDIKGQWDRLVINTQSFPNNYWDKFVKRKVMDKYGEFYGRDRISELLGMDKAALDFS
SEQ ID NO:61    PLVIFKREKEVARKLEFDGLYITEQPSE------DDIKGQWDRLVINTQSFPNNYWDKFVKRKVMDKYGEFYGRDRISELLGMDKAALDFS
SEQ ID NO:62    PLVIFKREKEVARKLEFDGLFIAEQPSE------DDIKGQWDRLVINTQSFPNNYWDKFVKRKVMDKYGEFYGRDRISELLGMDKAALDFS

SEQ ID NO:2     EEEGSKG-------LIHYIINIDWRYQVWK-AGVTITDNSFLYSLWYFSFSVMGNFNN-FFFAAHLLDVAVGFKTLRTILQSVTHNGKQLV
SEQ ID NO:128   EEEGSKG-------LIHYIINIDWRYQVWK-AGVTITDNSFLYSLWYFSFSVMGNFNN-FFFAAHLLDVAVGFKTLRTILQSVTHNGKQLV
SEQ ID NO:130   EEEGSKG-------LIHYIINIDWRYQVWK-AGVTITDNSFLYSLWYFSFSVMGNFNN-FFFAAHLLDVAVGFKTLRTILQSVTHNGKQLV
SEQ ID NO:144   EEEGSKG-------LIHYIINIDWRYQVWK-AGVTITDNSFLYSLWYFSFSVMGNFNN-FFFAAHLLDVAVGFKTLRTILQSVTHNGKQLV
SEQ ID NO:146   EEEGSKG-------LIHYIINIDWRYQVWK-AGVTITDNSFLYSLWYFSFSVMGNFNN-FFFAAHLLDVAVGFKTLRTILQSVTHNGKQLV
SEQ ID NO:4     ENEERTG-------LINFVINIDWRYQVWK-AGVTITDNAFLYSLWYFTFSILGNFNN-FFFAAHLLDVAVGFKTLRTILQSVTHNGKQLV
SEQ ID NO:6     ENEERTG-------LINFVINIDWRYQVWK-AGVTITDNAFLYSLWYFTFSILGNFNN-FFFAAHLLDVAVGFKTLRTILQSVTHNGKQLV
SEQ ID NO:8     ETEEGTG-------IINFILNIDWRYQVWK-AGVTITDNAFLYSLWYFIFSILGNFNN-FFFAAHLLDVAVGFKTLRTILQSVTHNGKQLV
SEQ ID NO:10    ESEETG--------IFKYIMNIDWRYQVWK-AGVTFTDNAFLYSLWYFSFSVMGNFNN-FFFAAHLLDVAVGFKTLRTILQSVTHNGKQLV
SEQ ID NO:56    ESEETG--------IFKYIMNIDWRYQIWK-AGVTITDNAFLYSLWYFSFSVMGNFNQ-FFFAAHLLDVAVGFKTLRTILQSVTHNGKQLV
SEQ ID NO:57    EANEGGG-------FFHFITNIDWRYQIWK-AGVTFTDNSFLYSLWYFLYRVGYLLCSACGVFLSPFYAFHLIDVVLSFPMLKAILQSVTHNLQQLI
SEQ ID NO:58    DS----------S-YDYRYSCWLWIGVILTNGQFLYRVGYLLCSACGVFLSPFYAFHLIDVVLSFPMLKAILQSVTHNLQQLI
SEQ ID NO:59    GNPTENP--NQGLFSSMLTSLDWKYHIWK-CGVIGTDNSFLYIAWYLLFSLLGHINP-FFFAAHLLDIAMGFKTLRTILSSVTHNGKQLI
SEQ ID NO:60    DAREKKKPKKDSSLSAVLNSIDVKYQMWK-LGVVFTDNSFLYLAWYMTMSILGHYNN-FFFAAHLLDIAMGFKTLRTILSSVTHNGKQLV
SEQ ID NO:61    DAREKKKPKKDSSLSAVLNSIDVKYQMWK-LGVVFTDNSFLYLAWYMTMSILGHYNN-FFFAAHLLDIAMGFKTLRTILSSVTHNGKQLV
SEQ ID NO:62    DAREKKKPKKDSSLSAVLNSIDVKYQMWK-LGVVFTDNSFLYLAWYMTMSVLGHYNN-FFFAAHLLDIAMGFKTLRTILSSVTHNGKQLV
```

FIGURE 1EE

```
SEQ ID NO:2    LTVMLLTIIVYIYTVIAFNFFRKFYVQGED--DEVNRNCHDMLTCFVFNLYKGVRAGGIGDELEPPDGDDSEVYRIIFDISFFFIIVI
SEQ ID NO:128  LTVMLLTIIVYIYTVIAFNFFRKFYVQEED--DEVNRNCHDMLTCFVFNLYKGVRAGGIGDELEPPDGDDSEVYRIIFDISFFFIIVI
SEQ ID NO:130  LTVMLLTIIVYIYTVIAFNFFRKFYVQEED--DEVNRNCHDMLTCFVFNLYKGVRAGGIGDELEPPDGDDSEVYRIIFDISFFFIIVI
SEQ ID NO:144  LTVMLLTIIVYIYTVIAFNFFRKFYVQEED--DEVNRNCHDMLTCFVFNLYKGVRAGGIGDELEPPDGDDSEVYRIIFDISLFFFIVI
SEQ ID NO:146  LTVLLLTIIVYIYTVIAFNFFRKFYVQEED--DEVNRNCHDMLTCFVFHLYKGVRAGGIGDEIGSPDGDDYEVYRIMFDITFFFVIII
SEQ ID NO:4    LTVLLLTIIVYIYTVIAFNFFRKFYVQEED--DEVDKKCHDMLTCFVFHLYKGVRAGGIGDEIGSPDGDDYEVYRIMFDITFFFFVIII
SEQ ID NO:6    LTVMLLTIIVYIYTVIAFNFFRKFYVQEED--DEVDKKCHDMLTCFVFHLYKGVRAGSIGDEIEPPDGDDYEVYRIMFDITFFFFVIII
SEQ ID NO:8    LTVMLLTIIVYIYTVIAFNFFRKFYIREED--EEVDKKCHDMLTCFVFHLYKGVRAGSIGDEIEPPDGDDYEVYRIMFDITFFFFVIII
SEQ ID NO:10   LTVMLLTIIVYIYTVIAFNFFRKFYIQEED--EEVDKKCHDMLTCFVFHLYKGARAGGIGDEIGDPDGDDYEVYRIIFDITFFFFVIII
SEQ ID NO:56   LTVMLLTIIVYIYTVIAFNFFRKFYIQEED--EEVDKKCHDMLTCFVFHLYKGVRAGGIGDEIGDPDGDDYEVYRIIFDITFFFFVIVI
SEQ ID NO:57   LTVMLLTIIVYIYTVIAFNFFRKFYIQEED--EEVDKKCHDMLTCFVFHLYKGVRAGGIGDEIGDPDGDDYEVYRILFDITFFFFVIVI
SEQ ID NO:58   LTIMMTLVVVYLYTVIAFNFFRKFYVQEDDDGEEGEEPDRKCHDMATCFVFHLYFYAGVRAGGIGDELESPYGDDLEYPRMFYDISFFFVIII
SEQ ID NO:59   LTLMMTCVIIYLYTVLAFNFFRKFYVQEGEGEGEEPDRKCHNMLTCFIYHFYAGVRAGGIGDELESPYGDDVYEYYRIIFDITFFFVIVI
SEQ ID NO:60   LTVGLLAVVVYLYTVAFNFFRKFYTKDDE-GE-IEYKCHNMMSCFVFHLHSGLRAGGIADEIEAPDGDVYEYYRIEIYRIIFDITFFFFVIVI
SEQ ID NO:61   LTVGLLAVVVYLYTVAFNFFRKFYNKSED--GDTPDMKCDDMLTCYMFHMYGVRAGGIGDEIEDPAGDEYEIYRIIFDITFFFFVIVI
SEQ ID NO:62   LTVGLLAVVVYLYTVVAFNFFRKFYNKSED--GDTPDMKCDDMLTCYMFHMYGVRAGGIGDEIEDPAGDEYEIYRIIFDITFFFFVIVI

SEQ ID NO:2    LLAILQGLIIDAFGELRDQLESVKEDMESNCFICGINKDYFDKVPHGFDTHVQREHNLANYMFFLMHLINKPDTEYTGQETYVWNMYTQR
SEQ ID NO:128  LLAILQGLIIDAFGELRDQLESVKEDMESNCFICGINKDYFDKVPHGFDTHVQREHNLANYMFFLMHLINKPDTEYTGQETYVWNMYTQR
SEQ ID NO:130  LLAILQGLIIDAFGELRDQLESVKEDMESNCFICGINKDYFDKVPHGFDTHVQREHNLANYMFFLMHLINKPDTEYTGQETYVWNMYTQR
SEQ ID NO:144  LLAILQGLIIDAFGELRDQLESVKEDMESNCFICGINKDYFDKVPHGFDTHVQREHNLANYMFFLMHLINKPDTEYTGQETYVWNMYTQR
SEQ ID NO:146  LLAILQGLIIDAFGELRDQLESVKEDMESNCFICGINKDYFDKVPHGFDTHVQREHNLANYMFFLMHLINKPDTEYTGQETYVWNMYTQR
SEQ ID NO:4    LLAILQGLIIDAFGELRDQLESVKEDMESNCFICGINKDYFDKVPHGFDTHVQEEHNLANYMFFLMHLINKPDTEYTGQETYVWNMYQQR
SEQ ID NO:6    LLAIIQGLIIDAFGELRDQLESVKEDMESNCFICGIGKDYFDKVPHGFDTHVQEEHNLANYMFFLMHLINKPDTEYTGQETYVWNMYQQR
SEQ ID NO:8    LLAIIQGLIIDAFGELRDQLESVKEDMESNCFICGIGKDYFDKVPHGFDTHVQEEHNLANYMFFLMHLINKPDTEYTGQETYVWNMYQQR
SEQ ID NO:10   LLAIIQGLIIDAFGELRDQLESVKDNMESNCFICGMGKDFFDKVPHGFDTHVQKEHNLANYMFFLMHLINKPDTEYTGQETYVWNMYQQR
SEQ ID NO:56   LLAIIQGLIIDAFGELRDQLESVKDNMESNCFICGMGKDFFDKVPHGFDTHVQKEHNLANYMFFLMHLINKPDTEYTGQETYVWNMYQQR
SEQ ID NO:57   LLAIIQGLIIDAFGELRDQLESVKDNMESNCFICGMGKDFFDKVPHGFDTHVAQEHNLANYMFFLMHLINKPDTEYTGQETYVREKYDNR
SEQ ID NO:58   LLAIMQGLIIDAFGELRDQQESATEKLESSCFICDIGKETFDRMPRGFEIHTTKEHNFANYLFFLQHLVNKDETEYTGQETYVREKYDNR
SEQ ID NO:59   LLAIIQGLIIDAFGELRDQLEQVREDMETKCFICSIGREYFDKLPHGFELHTSKEHDLSNYMFFLMYLINKPETEHTGQESYVWQLYQQR
SEQ ID NO:60   LLAIIQGLIIDAFGELRDQQEQVKEDMETKCFICGIGNDYFDTVPHGFETHTLQEHNLANYLFFLMYLINKDETEHTGQESYVWKMYQER
SEQ ID NO:61   LLAIIQGLIIDAFGELRDQQEQVKEDMETKCFICGIGNDYFDTVPHGFETHTLQEHNLANYLFFLMYLINKDETEHTGQESYVWKMYQER
SEQ ID NO:62   LLAIIQGLIIDAFGELRDQQEQVKEDMETKCFICGIGNDYFDTVPHGFETHTLQEHNLANYLFFLMYLINKDETEHTGQESYVWKMYQER
```

FIGURE 1FF

```
SEQ ID NO:2     CWDFFPVGDCFRKQYEDLMGE-----
SEQ ID NO:128   CWDFFPVGDCFRKQYEDLMGE-----
SEQ ID NO:130   CWDFFPVGDCFRKQYEDLMGE-----
SEQ ID NO:144   CWDFFPVGDCFRKQYEDLMGE-----
SEQ ID NO:146   CWDFFPVGDCFRKQYEDLMGE-----
SEQ ID NO:4     CWDFFPVGDCFRKQYEELGGGGGV-
SEQ ID NO:6     CWDFFPVGDCFRKQYEELGGGGGV-
SEQ ID NO:8     CWDFFPVGDCFRKQYEDELGGGG--
SEQ ID NO:10    SWDFFPVGDCFRKQYEDELSGGGGGG
SEQ ID NO:56    SWDFFPVGDCFRKQYEDELSGGGGGG
SEQ ID NO:57    CWDFFPVGDCFRKQYEDELGGGGS--
SEQ ID NO:58    DWDFFPVGECFVKQYEDQLLQS----
SEQ ID NO:59    CWDFFPVGDCFRKQYDDEQA------
SEQ ID NO:60    CWEFFPAGDCFRKQYEDQLN------
SEQ ID NO:61    CWEFFPAGDCFRKQYEDQLN------
SEQ ID NO:62    CWEFFPAGDCFRKQYEDQLN------
```

```
SEQ ID NO:2    = tobacco budworm         (5142 amino acids)
SEQ ID NO:128  = tobacco budworm HV7     (5128 amino acids)
SEQ ID NO:130  = tobacco budworm HV2     (5135 amino acids)
SEQ ID NO:144  = tobacco budworm HV3     (5142 amino acids)
SEQ ID NO:146  = tobacco budworm HV6     (5100 amino acids)
SEQ ID NO:4    = green peach aphid       (5101 amino acids)
SEQ ID NO:6    = cotton melon aphid      (5104 amino acids)
SEQ ID NO:8    = corn plant hopper       (5127 amino acids)
SEQ ID NO:10   = fruitfly (DuPont)       (5109 amino acids)
SEQ ID NO:56   = fruitfly gi17352471     (5113 amino acids)
SEQ ID NO:57   = mosquito gi21301556     (4868 amino acids)
SEQ ID NO:58   = nematode gi1871447      (5071 amino acids)
SEQ ID NO:59   = sea urchin gi18656155   (5317 amino acids)
SEQ ID NO:60   = mouse gi13569850        (4967 amino acids)
SEQ ID NO:61   = rabbit gi1245376        (4968 amino acids)
SEQ ID NO:62   = human gi4506757         (4967 amino acids)
```

FIGURE 2
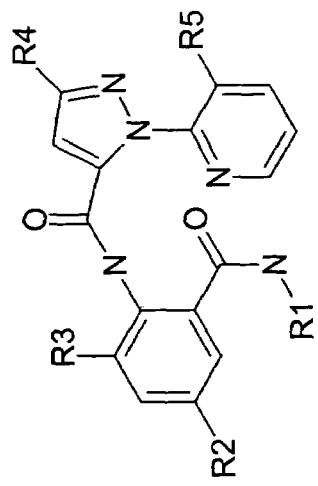
Group 2
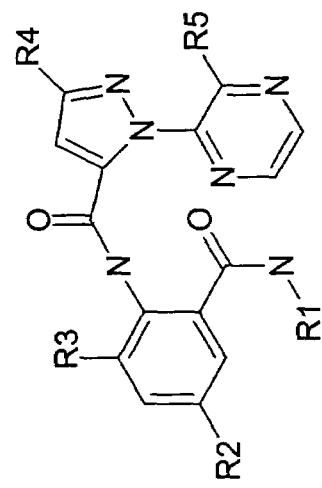
Group 3
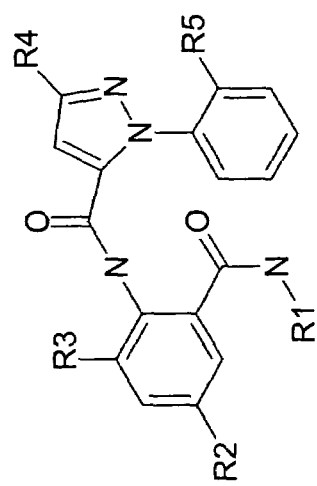
Group 1

NUCLEIC ACIDS ENCODING RYANODINE RECEPTORS

This application claims the benefit of U.S. Provisional Application No. 60/412,795, filed Sep. 23, 2002, and of U.S. Provisional Application No. 60/427,324, filed Nov. 18, 2002, the disclosures of which are hereby incorporated by reference in their entirety.

FIELD OF THE INVENTION

The present invention is in the field of ryanodine receptors and, in particular, relates to recombinant constructs useful for modulating ryanodine receptor activity and to methods for evaluating compounds that modulate such activity.

BACKGROUND OF THE INVENTION

Calcium homeostasis in the cytosol of vertebrate and invertebrate muscle cells is essential for normal cellular activity. It is a complex process involving balancing calcium from extracellular sources that moves through calcium selective channels on the plasma membrane of the cell, and calcium in internal stores controlled by a calcium activated calcium release channel located in the membrane of the sarcoplasmic reticulum. Release of calcium from the sarcoplasmic reticulum plays a crucial role in excitation-contraction coupling in muscle tissue (Pessah et al., (1986) *J Biol Chem* 261:8643–8648) and the initiation and propagation of calcium signaling events.

The calcium activated calcium release channel internal to the cell is called the ryanodine receptor (Ryr) because of the interaction of the receptor with a natural insecticide ryanodine, an alkaloid from the *Ryania speciosa*. Ryanodine binding sites have been studied in an effort to understand the properties of the $Ca^{2+}$ release channel in insects as a possible target for insecticide action (Lehmberg et al., (1994) *Pesticide Biochem and Physiol* 48: 145–152). However, no synthetic insecticides acting on the ryanodine receptor as a primary mode of action have been discovered until recently. Chemistry based on derivatives of anthranilamides with very potent activity on pest species activate this receptor in a manner leading to calcium release, thereby disrupting the calcium balance of the insect cell. The response of the organism as a result of this disruption is unrelieved muscle contraction, including cardiac, skeletal and pharyngeal muscles, leading to lethargy and cessation of feeding.

It is reported in insects that there is only one form of the receptor-ion channel. Studies in insect tissues indicate that the receptor has similar properties and size to its mammalian homologue (Denser et al., (1998) *Pestic. Sci.* 54:345–352). The ryanodine receptor has been most studied in mammals where there are three currently recognized isoforms (types 1, 2, and 3) which are subject to differential regulation and have different tissue distributions.

Full-length genomic DNA sequence (Takeshima et al. (1994) *FEBS Lett.*, 337: 81–87) and cDNA sequence (Xu et al. (2000) *Biophys J.* 78: 1270–1281) of the *Drosophila* gene encoding a ryanodine receptor is known and available from public databases (NCBI Accession No. D17389), from other invertebrates, e.g. *Caenorhabditis elegans* (NCBI Accession No. D45899) and a small segment of the C-terminus of the ryanodine receptor from the tobacco budworm, a lepidopteran pest (*Heliothis virescens*; Puente et al.,(2000) *Insect Biochem. Mol. Biol.* 30: 335–347). The sequence from Drosophila has been cloned and expressed in Chinese Hamster Ovary (CHO) cells and the receptor-ion channel shown to be functional using electro-conductance techniques (Xu et al. (2000) *Biophys J.* 78: 1270–1281).

Crop destruction by pests such as insects results in a considerable economic loss and serious reduction in productivity. For example, lepidopteran pest species cause $500 MM of damage to various crop species annually. Homopteran pests account for a further $2000 MM. Recently, two areas of chemistry have shown good control of lepidopteran pests. From an analysis of intracellular calcium changes and the physiological response of the pest to the compounds the mode of action is by disruption of normal muscle function through the release and eventual depletion of internal calcium stores in the muscle and central nervous system. Thus, based on the response of cells expressing the ryanodine receptor either in natural or recombinant systems to various types of low molecular weight chemical structures, it is clear the receptor and potentially other attendant components that interact with it are important targets for pest control.

SUMMARY OF THE INVENTION

This invention concerns an isolated nucleotide fragment comprising a nucleic acid sequence consisting of a nucleic acid sequence encoding a ryanodine receptor having an amino acid sequence identity of at least 75%, 80%, 85%, 90%, 95%, or 100% when compared to a polypeptide selected from the group consisting of SEQ ID NO:2, 4, 6, 8, 10, 128, 130, 144, or 146. Also of interest is the complement of such isolated nucleic acid fragments.

In a second embodiment, this invention concerns an isolated nucleic acid fragment wherein the nucleic acid sequence comprises the nucleotide sequence of SEQ ID NO:1, 3, 5, 7, 9, 127, 129, 143, or 145.

In a third embodiment, this invention concerns such previously mentioned nucleic acid fragments, and complements thereof, wherein the fragment or parts thereof are useful in a recombinant construct for the purpose of overexpression, antisense inhibition, or co-suppression of ryanodine receptor activity in a host cell.

In a fourth embodiment, this invention concerns recombinant DNA constructs comprising any of the foregoing nucleic acid fragment or complement thereof or part of either operably linked to at least one regulatory sequence. Also, of interest are eukaryotic or prokaryotic host cells comprising such recombinant DNA constructs in their genome. Useful host cells include, but are not limited to, *E. coli*, yeast, Sf9, S2, Xenopus oocytes, HEK-293 and CHO cells.

In a fifth embodiment, this invention concerns a method to isolate nucleic acid fragments encoding ryanodine receptors and related polypeptides, comprising:
  (a) comparing SEQ ID NO:2, 4, 6, 8, 10, 128, 130, 144, and 146 and other ion channel and receptor polypeptide sequences;
  (b) identifying the conserved sequences of 4 or more amino acids obtained in step a;
  (c) designing degenerate oligomers based on the conserved sequences identified in step b; and
  (d) using the degenerate oligomers of step c to isolate sequences encoding polypeptides having ryanodine receptor activity by sequence dependent protocols.

In a sixth embodiment, this invention concerns an isolated polypeptide having ryanodine receptor activity, wherein the amino acid sequence of the polypeptide and the amino acid sequence of SEQ ID NO:2, 4, 6, 8, 10, 128, 130, 144, or 146 have at least 75%, 80%, 85%, 90%, 95%, or 100% identity.

One skilled in the art would realize that any integer percent identity from 75% to 100% would be useful in isolating ryanodine receptor-like polypeptide sequences.

In a seventh embodiment, this invention concerns a method for evaluating at least one compound for its ability to modulate calcium homeostasis, the method comprising the steps of:
 (a) transforming a host cell with any one of the aforementioned recombinant constructs;
 (b) growing the transformed host cell under conditions that are suitable for expression of the recombinant construct wherein expression of the recombinant construct results in altered calcium homeostasis;
 (c) treating the transformed host cell of step (a) with a compound to be tested; and
 (d) determining changes in intracellular homeostasis by the test compound in order to select compounds with potential for altering calcium release.

This method wherein the method can be, but is not limited to, a ligand binding assay. Furthermore, this method can be based on assessing functional activity by detecting the effect of a compound on the functional activity of the transformed host cell or ion channels obtained from such cells.

In an eighth embodiment, this invention concerns a method for evaluating at least one compound which modulates ryanodine receptor activity, the method comprising the steps of:
 (a) contacting at least one compound with a polypeptide encoded by any one of the aforementioned isolated nucleic acid fragments; and
 (b) evaluating the ryanodine receptor activity of the polypeptide of (a) after said polypeptide has been contacted with the compound or compounds.

This method wherein the method can be, but is not limited to, a ligand binding assay. Furthermore, this method can be useful wherein the polypeptide is contacted with more than one compound.

A further embodiment of the present invention would be an isolated nucleic acid fragment encoding an insect ion channel comprising at least two polypeptide sequences set forth in any of SEQ ID NOs:63–119 provided that said polypeptide sequences do not comprise any of SEQ ID NOs:56, 120–126.

Yet another embodiment would be a method for identifying a nucleic acid sequence encoding an insect ion channel comprising:
 a) obtaining an isolated nucleic acid sequence encoding a first polypeptide having at least 100 amino acids;
 b) comparing the first polypeptide sequence with a comparative polypeptide sequence selected from the group consisting of SEQ ID NOs:63–119 to identify a region between the first polypeptide and the comparative polypeptide having 100% sequence identity wherein said region is as long as the comparative polypeptide; and
 c) repeating step (b) with a different comparative polypeptide sequence, wherein said different comparative polypeptide sequence is selected from the group consisting of SEQ ID NOs:63–119 until a second region having 100% sequence identity is found, wherein said second region is as long as the different comparative polypeptide. The method could be further characterized by the length of the first polypeptide having a length of from 100 to 6,000 amino acids.

Yet a further embodiment of the present invention would be a method for expressing an isolated nucleic acid fragment encoding a toxic insect ion channel comprising:
 a) transforming a host with a recombinant construct comprising in the 5' to 3' direction a promoter operably linked to the toxic insect ion channel nucleic acid, wherein the promoter comprises a transcription termination nucleic acid fragment, and/or an in-frame translation stop codon, situated between said promoter and the isolated nucleic acid fragment encoding the toxic insect ion channel, and further wherein the transcription termination nucleic acid fragment, and/or an in-frame translation stop codon, is flanked on each end by at least one nucleic acid sequence consisting essentially of excisable sequences; and
 b) growing the transformed host under conditions that are suitable for the expression of the recombinant construct. The excisible sequences may be any sequences recognized by recombinase enzymes, such as but not limited to, lox sites.

A related embodiment of the present would encompass the recombinant constructs themselves comprising in the 5' to 3' direction a promoter operably linked to an isolated nucleic acid fragment encoding a toxic insect ion channel, wherein the promoter comprises a transcription termination nucleic acid fragment, and/or at least one in-frame translational termination codon, situated between said promoter and the isolated nucleic acid fragment encoding the toxic insect ion channel, and further wherein the transcription termination nucleic acid fragment, and/or at least one in-frame translational termination codon, is flanked on each end by at least one nucleic acid sequence consisting essentially of excisable sequences. The excisible sequences may be any sequences recognized by recombinase enzymes, such as but not limited to, lox sites.

Another embodiment of the present invention would be a method for expressing an isolated nucleic acid fragment encoding a toxic insect ion channel comprising:
 a) transforming a host with a recombinant expression construct comprising in the 5' to 3' direction a promoter operably linked to an isolated nucleic acid fragment encoding the toxic insect ion channel, wherein said fragment also comprises an intron which interferes with expression of said fragment, and
 b) growing the transformed host under conditions that are suitable for the expression of the recombinant construct.

In still another embodiment, the present invention would encompass a recombinant expression construct comprising in the 5' to 3' direction a promoter operably linked to an isolated nucleic acid fragment encoding a toxic insect ion channel wherein said isolated nucleic acid fragment also comprises an intron which interferes with expression of the toxic insect ion channel.

BRIEF DESCRIPTION OF THE FIGURES AND SEQUENCE LISTINGS

The invention can be more fully understood from the following detailed description and the accompanying drawings and Sequence Listing which form a part of this application.

FIG. 1 shows an alignment of the deduced amino acid sequences for five ryanodine receptors from a lepidopteran species, tobacco budworm (*Heliothis virescens*, SEQ ID NOs:2,128,130,144 and 146), green peach aphid (*Myzus persicae*, SEQ ID NO:4), cotton melon aphid (*Aphis gossypii*, SEQ ID NO:6), and corn plant hopper (*Peregrinus maidis*, SEQ ID NO:8), compared to a fruitfly (*Drosophila melanogaster*) sequence generated by the methods disclosed herein (SEQ ID NO:10), the *Drosophila* art sequence (NCBI General Identifier No. gi 17352471, SEQ ID NO:56), an unannotated sequence from the mosquito (*Anopheles gambiae*) genome sequencing project (gi 21301556, SEQ ID NO:57), the ryanodine receptor from nematodes (*Caenorhabditis elegans*, gi 1871447, SEQ ID NO:58), sea urchin (*Hemicentrotus pulcherrimus*, gi 18656155, SEQ ID NO:59), mouse (*Mus musculus*, gi 13569850, SEQ ID NO:60), rabbit (*Oryctolagus cuniculus*, gi 1245376, SEQ ID NO:61), and human (*Homo sapiens*, gi 4506757, SEQ ID NO:62). Insect specific sequences can be identified by finding homologous subsequences that are conserved between all of the insect sequences but not among the non-insect sequences. A number of these sequences can be found in SEQ ID NOs:63–119.

FIG. 2 shows chemical structures of three classes of anthranilamides that were used in the calcium release assays presented in Example 9, or in the radio-labeled binding studies presented in Example 11.

FIG. 3 shows an example of calcium responses elicited by either caffeine or Compound 16 (Table 7), from a recombinant *Spodoptera frugiperda* cell line (Sf9) transiently expressing a *Drosophila melanogaster* ryanodine receptor. Cells were challenged 96 hr post-transfection with the ryanodine receptor agonist, caffeine (10 mM) and Compound 16 (10 and 100 nM). No significant calcium responses were observed with caffeine (10 mM) or Compound 16 (10 and 100 nM) in control cells without DNA.

Figure 4:
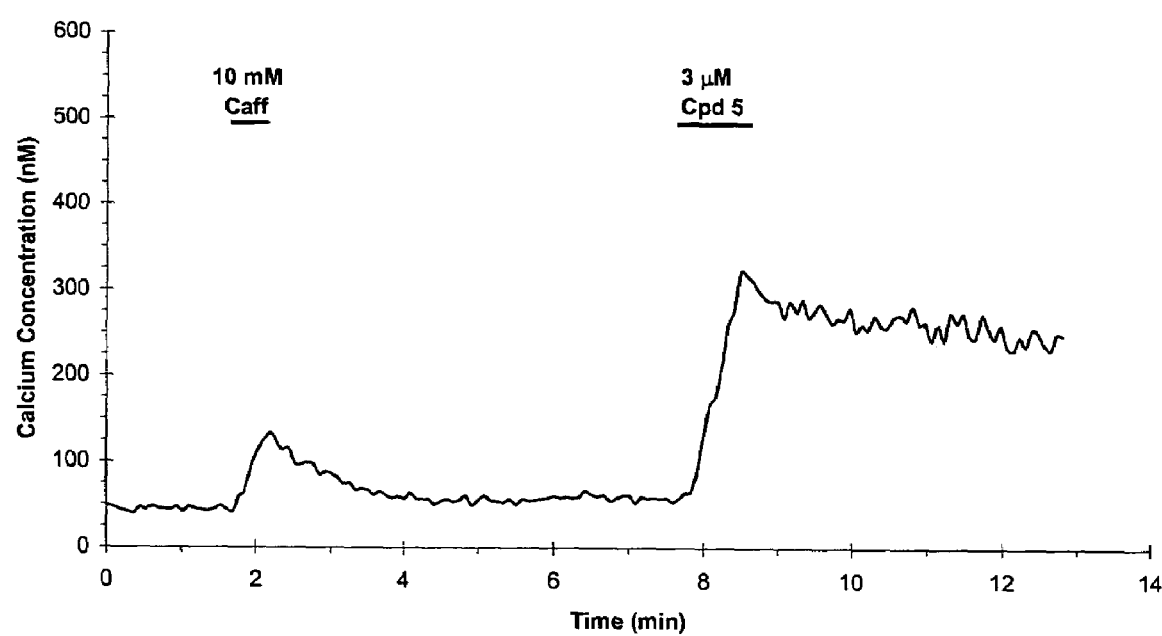

FIG. 4 shows an example of calcium responses elicited by either caffeine or Compound 5 (Table 7), from a recombinant *Spodoptera frugiperda* cell line (Sf9) transiently expressing a recombinant *Heliothis virescens* ryanodine receptor. Cells were challenged 72 hr post-transfection with the ryanodine receptor agonist, caffeine (10 mM) and Compound 5 (3 µM). No significant calcium responses were observed with caffeine (10 mM) or Compound 5 (3 µM) in control cells without DNA.

Figure 5:
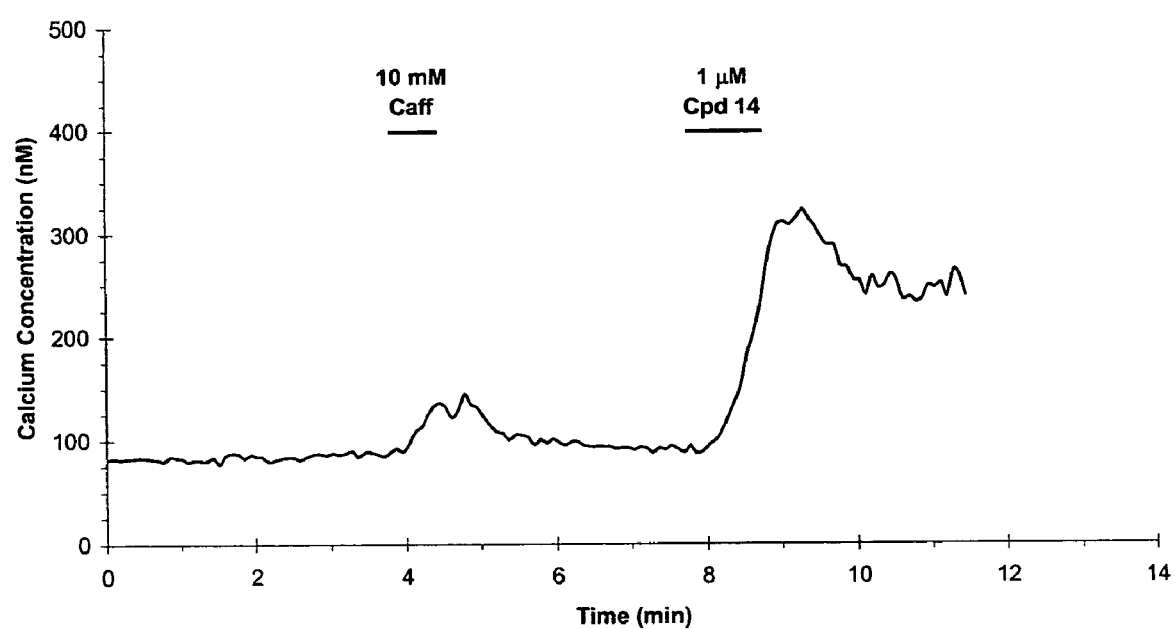

FIG. 5 shows an example of calcium responses elicited by either caffeine or Compound 14 (Table 7), from a recombinant *Spodoptera frugiperda* cell line (Sf9) stably expressing a recombinant *Heliothis virescens* ryanodine receptor. Cells were challenged with the ryanodine receptor agonist, caffeine (10 mM) and Compound 14 (1 µM). Sf9 cells were allowed to attach to a glass coverslip then loaded with the calcium probe Fura-2 AM and assayed using a calcium imaging system to monitor calcium mobilization.

Figure 6:
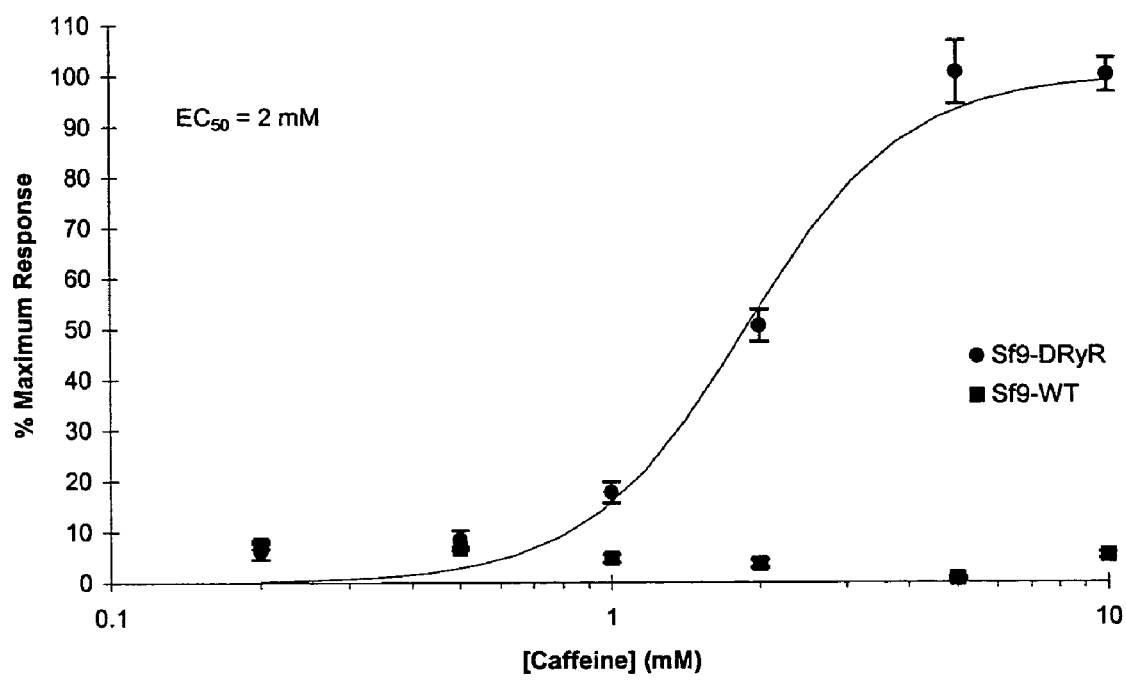

FIG. 6 shows the caffeine dose response curve for wild type *Spodoptera frugiperda* (Sf9-WT), and recombinant Sf9 cells stably expressing *Drosophila melanogaster* ryanodine receptors (Sf9-DryR). Sf9 cells were loaded with the calcium probe Fura-2 then plated into a 96-well microtiter plate and assayed using a Molecular Devices' FlexStation™ plate reader with integrated fluidics to measure calcium mobilization.

Figure 7:
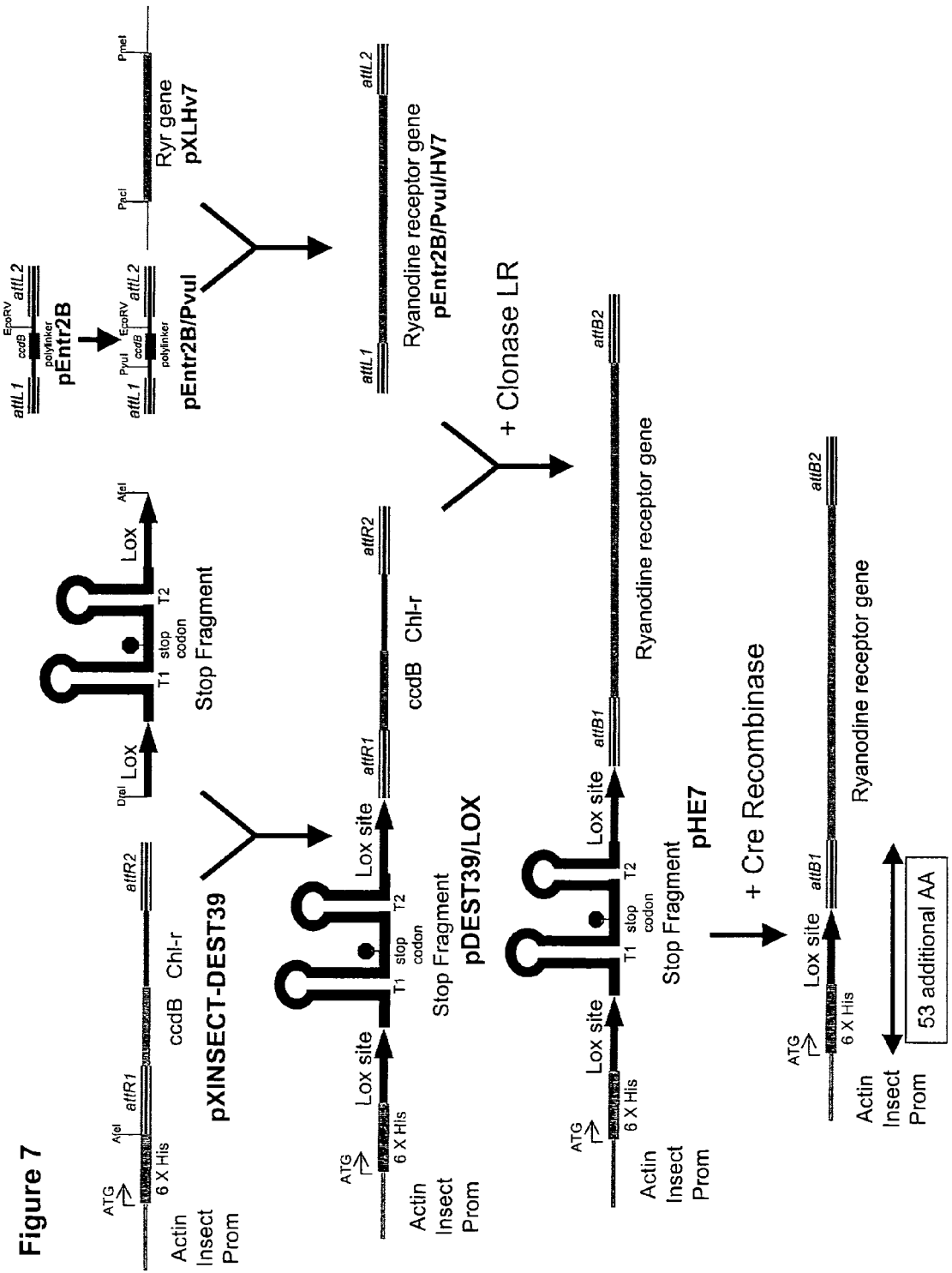

FIG. 7 shows a schematic overview of construction of pHE7. For clarity, DNA fragments are not drawn to scale, circular plasmids are depicted in a linear fashion, and only the relevant portions of the plasmids are shown.

Table 1 lists the polypeptides that are described herein, the designation of the genomic or cDNA clones that comprise the nucleic acid fragments encoding polypeptides representing all or a substantial portion of these polypeptides, and the corresponding identifier (SEQ ID NO:) as used in the attached Sequence Listing. The sequence descriptions and Sequence Listing attached hereto comply with the rules governing nucleotide and/or amino acid sequence disclosures in patent applications as set forth in 37 C.F.R. §1.821–1.825.

TABLE 1

Nucleic Acid Fragments Encoding Ryanodine Receptors

| | | SEQ ID NO: | |
|---|---|---|---|
| Ryanodine Receptor | Clone Designation | (Nucleotide) | (Amino Acid) |
| tobacco budworm (*Heliothis virescens*) | pXL-Hv3-5 | 1 | 2 |
| tobacco budworm (*Heliothis virescens*) | pXLHv7 | 127 | 128 |
| tobacco budworm (*Heliothis virescens*) | pXLHv2 | 129 | 130 |
| tobacco budworm (*Heliothis virescens*) | pXLHv3 | 143 | 144 |
| tobacco budworm (*Heliothis virescens*) | pXLHv6 | 145 | 146 |
| green peach aphid (*Myzus persicae*) | pIB-GPA7-1 | 3 | 4 |
| cotton melon aphid (*Aphis gossypii*) | pIB-CMA4-3 | 5 | 6 |
| corn plant hopper (*Peregrinus maidis*) | pXL-CPH9 | 7 | 8 |
| fruit fly (*Drosophila melanogaster*) | pIB43D | 9 | 10 |

The odd-numbered SEQ ID NOs:1, 3, 5, 7, 9, 127, 129, 143, and 145 represent the polynucleotide sequences for the sequences encoding a ryanodine receptor from the species indicated. The even-numbered SEQ ID NOs:2, 4, 6, 8, 10, 128, 130, 144, and 146 represent the translated amino acid sequence derived from the corresponding odd-numbered polynucleotide sequence. SEQ ID NOs:11–55 are nucleotide primers used in PCR amplification, and sequencing, experiments during the isolation and characterization of the ryanodine receptors from various insect sources. An unannotated mosquito genomic sequence (SEQ ID NO:57) is believed to encode a partial ryanodine receptor (from analysis done by the authors of the present invention). SEQ ID NOs:56, 58–62 and 120–126 are ryanodine receptor sequences existing in the Genbank database. SEQ ID NOs:63–119 are amino acid sequence motifs believed to be conserved in insect ryanodine receptors. SEQ ID NOs:131–142 represent PCR primer sequences and oligonucleotides used in the amplification of ryanodine receptor coding regions for cloning into expression vectors (see Example 7).

The Sequence Listing contains the one letter code for nucleotide sequence characters and the three letter codes for amino acids as defined in conformity with the IUPAC-IUBMB standards described in *Nucleic Acids Res.* 13:3021–3030 (1985) and in the *Biochemical J.* 219 (No. 2):345–373 (1984) which are herein incorporated by reference. The symbols and format used for nucleotide and amino acid sequence data comply with the rules set forth in 37 C.F.R. §1.822.

DETAILED DESCRIPTION OF THE INVENTION

As used herein, an "isolated nucleic acid fragment" is a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA. Nucleotides (usually found in their 5'-monophosphate form)

are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, "W" for A or T, "S" for C or G, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric constructs to produce the desired phenotype in a transformed plant. Chimeric constructs can be designed for use in co-suppression or antisense by linking a nucleic acid fragment or subfragment thereof, whether or not it encodes an active enzyme, in the appropriate orientation relative to a plant promoter sequence.

The terms "homology", "homologous", "substantially similar", "consisting essentially of", and "corresponding substantially" are used interchangeably herein. They refer to nucleic acid fragments wherein changes in one or more nucleotide bases does not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize, under moderately stringent conditions (for example, 1×SSC, 0.1% SDS, 60° C.) with the sequences exemplified herein, or to any portion of the nucleotide sequences reported herein and which are functionally equivalent to the gene or the promoter of the invention. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions. One set of preferred conditions involves a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions involves the use of higher temperatures in which the washes are identical to those above except for the temperature of the final two 30 min washes in 0.2×SSC, 0.5% SDS was increased to 60° C. Another preferred set of highly stringent conditions involves the use of two final washes in 0.1×SSC, 0.1% SDS at 65° C.

With respect to the degree of substantial similarity between the target (endogenous) mRNA and the RNA region in the construct having homology to the target mRNA, such sequences should be at least 25 nucleotides in length, preferably at least 50 nucleotides in length, more preferably at least 100 nucleotides in length, again more preferably at least 200 nucleotides in length, and most preferably at least 300 nucleotides in length; and should be at least 80% identical, preferably at least 85% identical, more preferably at least 90% identical, and most preferably at least 95% identical.

It is well understood by one skilled in the art that many levels of sequence identity are useful in identifying related polypeptide sequences. Useful examples of percent identities are 75%, 80%, 85%, 90%, or 95%, or any integer percentage from 75% to 100%. Sequence alignments and percent similarity calculations may be determined using a variety of comparison methods designed to detect homologous sequences including, but not limited to, the Megalign program of the LASARGENE bioinformatics computing suite (DNASTAR Inc., Madison, Wis.). Multiple alignment of the sequences are performed using the Clustal method of alignment (Higgins and Sharp (1989) CABIOS. 5:151–153) with the default parameters (GAP PENALTY=10, GAP LENGTH PENALTY=10). Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. For large protein sequences the Clustal W program (Thompson et al. (1994) Nuc Acids Res 22:46734680) was used. Default parameters were used (GAP PENALTY=10, GAP LENGTH PENALTY=0.2, DELAY DIVERGENT SEQ (%)=30, DNA TRANSITION WEIGHT=0.50, PROTEIN WEIGHT MATRIX: Gonnet 250, DNA WEIGHT MATRIX:IUB). Pairwise alignment also used default parameters (GAP PENALTY=10, GAP LENGTH PENALTY=0.10, PROTEIN WEIGHT MATRIX: Gonnet Series, DNA WEIGHT MATRIX:IUB).

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric construct", "recombinant construct", or recombinant expression construct" refers to a combination of nucleic acid fragments that are not normally found together in nature. Accordingly, a recombinant construct may comprise regulatory sequences and coding sequences that are derived from different sources, or regulatory sequences and coding sequences derived from the same source, but arranged in a manner different than that normally found in nature. A "foreign" gene refers to a gene not normally found in the host organism, but that is introduced into the host organism by gene transfer. Foreign genes can comprise native genes inserted into a non-native organism, or chimeric constructs. A "transgene" is a gene that has been introduced into the genome by a transformation procedure.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to, promoters, translation leader sequences, introns, and polyadenylation recognition sequences. The term "in-frame translational termination codon" refers to a UM, UAG, or UGA stop codon present within the preferred reading frame of an RNA transcript.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence which can stimulate promoter activity and may be an innate element of the promoter or a heterologous element inserted to enhance the level or tissue-specificity of a promoter. Promoter sequences can also be located within the transcribed portions of genes, and/or downstream of the transcribed sequences. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters which cause a gene to be expressed in most cell types at most times are commonly referred to as "constitutive promoters". New promoters of various types useful in plant cells are constantly being discovered; numerous examples may be found in the compilation by Okamuro and Goldberg, (1989) *Biochemistry of Plants* 15:1–82. It is further recognized that since in most cases the exact boundaries of regulatory sequences have not been completely defined, DNA fragments of some variation may have identical promoter activity. The term "inducible promoter" refers to a promoter that is normally quiescent that can be activated by trans-acting factors. Examples of such factors include, but are not limited to, proteins, chemicals, and factors that alter the local structure of the DNA.

An "intron" is an intervening sequence in a gene that does not encode a portion of the protein sequence. Thus, such sequences are transcribed into RNA but are then excised and are not translated. The term is also used for the excised RNA sequences. An "exon" is a portion of the sequence of a gene that is transcribed and is found in the mature messenger RNA derived from the gene, but is not necessarily a part of the sequence that encodes the final gene product.

The "translation leader sequence" refers to a DNA sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D. (1995) *Molecular Biotechnology* 3:225).

The "3'non-coding sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., (1989) *Plant Cell* 1:671–680.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA (mRNA)" refers to the RNA that is without introns and that can be translated into protein by the cell. "cDNA" refers to a DNA that is complementary to and synthesized from a mRNA template using the enzyme reverse transcriptase. The cDNA can be single-stranded or converted into the double-stranded form using the Klenow fragment of DNA polymerase 1. "Sense" RNA refers to RNA transcript that includes the mRNA and can be translated into protein within a cell or in vitro. "Antisense RNA" refers to an RNA transcript that is complementary to all or part of a target primary transcript or mRNA and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "endogenous RNA" refers to any RNA which is encoded by any nucleic acid sequence present in the genome of the host prior to transformation with the recombinant construct of the present invention, whether naturally-occurring or non-naturally occurring, i.e., introduced by recombinant means, mutagenesis, etc.

The term "non-naturally occurring" means artificial, not consistent with what is normally found in nature.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

The term "transcriptional termination nucleic acid fragment" refers to a nucleic acid fragment containing sequences recognized by nucleic acid binding proteins, or causing secondary structure(s), that cause RNA polymerase to stop transcription.

The term "expression", as used herein, refers to the production of a functional end-product. Expression of a gene involves transcription of the gene and translation of the mRNA into a precursor or mature protein. "Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020).

The term "excisible sequence", "excision site", or "excision sequence" are used interchangeably, and refer to any sequence, such as the Lox sequence, that is recognized by a recombinase enzyme, such as Cre. The activity of the Cre removes two Lox sequences, and any other nucleic acid between the Lox sequences, from a longer DNA fragment by recombination. As one skilled in the art would appreciate, several excision systems can be used that would be comparable to Cre/Lox described in Example 7. Examples of excision systems would include, but are not limited to, Cre/Lox (Odell et al. (1990) *Mol Gen Genet* 223:369–378); Flp/Frt (Lyznik et al. (1993) *Nuc Acids Res* 21:969–975); Clonase™/Att (Invitrogen Life Technologies™); Gin/Gix (Maeser and Kahmann (1991) *Mol Gen Genet* 230:170–176); and R/RS (Onouchi et al. (1991) *Nuc Acids Res* 19: 6373–6378).

As one skilled in the art would appreciate, several fragments flanked by excision sites can be used to eliminate or down-regulate expression in host cells equivalent to that described herein. Examples of such fragments include, but are not limited to, transcriptional terminators, stop codons that are in frame with the Ryr coding sequence, operators that are recognized by transcriptional repressors, translational attenuators, and sequences which interact with anti-sense or co-suppression constructs.

As one skilled in the art would appreciate, a stop fragment can be inserted at many different locations in the Ryr cDNA equivalent to that described herein. Examples of suitable locations would include, but are not limited to, in the promoter upstream of the gene, in the 5' untranslated leader, within the coding sequence, and in the 3' untranslated region.

As one skilled in the art would realize, placement of an intron within the coding region of a ryanodine receptor gene would impair the expression of active ryanodine receptor in host cells that are incapable of processing the intron removal from the RNA transcript.

"Mature" protein refers to a post-translationally processed polypeptide; i.e., one from which any pre- or propeptides present in the primary translation product have been removed. "Precursor" protein refers to the primary product of translation of mRNA; i.e., with pre- and propeptides still present. Pre- and propeptides may be but are not limited to intracellular localization signals.

"Motifs", "subsequences" or "segment" refer to short regions of conserved sequences of nucleic acids or amino acids that comprise part of a longer sequence. For example, it is expected that such conserved subsequences would be important for function, and could be used to identify new homologues of ryanodine receptors. It is expected that some or all of the elements may be found in a putative ryanodine receptor. Also, it is expected that one or two of the conserved amino acids in any given motif may differ in a true ryanodine receptor.

The term "homologous subsequence" used herein is meant to indicated two sequences that have 100% identity and co-linearity without gaps when aligned.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms. The preferred method of cell transformation of rice, corn and other monocots is the use of particle-accelerated or "gene gun" transformation technology (Klein et al., (1987) *Nature* (London) 327:70–73; U.S. Pat. No. 4,945,050), or an Agrobacterium-mediated method using an appropriate Ti plasmid containing the transgene (Ishida Y. et al., 1996, *Nature Biotech.* 14:745–750). The term "transformation" as used herein refers to both stable transformation and transient transformation.

The term "host cell" refers to any cell or organism into which an isolated nucleic acid fragment has been stably or transiently introduced. The host cell may be part of a larger organism, an individual in tissue culture, or a free-living organism. Examples of host cells include, but are not limited to, bacteria, fungi, insect, plant, and animal.

Standard recombinant DNA and molecular cloning techniques used herein are well known in the art and are described more fully in Sambrook, J., Fritsch, E. F. and Maniatis, T. *Molecular Cloning: A Laboratory Manual*; Cold Spring Harbor Laboratory Press: Cold Spring Harbor, 1989 (hereinafter "Sambrook").

The term "recombinant" refers to an artificial combination of two otherwise separated segments of sequence, e.g., by chemical synthesis or by the manipulation of isolated segments of nucleic acids by genetic engineering techniques.

"PCR" or "Polymerase Chain Reaction" is a technique for the synthesis of large quantities of specific DNA segments, consists of a series of repetitive cycles (Perkin Elmer Cetus Instruments, Norwalk, Conn.). Typically, the double stranded DNA is heat denatured, the two primers complementary to the 3' boundaries of the target segment are annealed at low temperature and then extended at an intermediate temperature. One set of these three consecutive steps is referred to as a cycle.

Polymerase chain reaction ("PCR") is a powerful technique used to amplify DNA millions of fold, by repeated replication of a template, in a short period of time. (Mullis et al, *Cold Spring Harbor Symp. Quant Biol.* 51:263–273 (1986); Erlich et al, European Patent Application 50,424; European Patent Application 84,796; European Patent Application 258,017, European Patent Application 237,362; Mullis, European Patent Application 201,184, Mullis et al U.S. Pat. No. 4,683,202; Erlich, U.S. Pat. No. 4,582,788; and Saiki et al, U.S. Pat. No. 4,683,194). The process utilizes sets of specific in vitro synthesized oligonucleotides to prime DNA synthesis. The design of the primers is dependent upon the sequences of DNA that are desired to be analyzed. The technique is carried out through many cycles (usually 20–50) of melting the template at high temperature, allowing the primers to anneal to complementary sequences within the template and then replicating the template with DNA polymerase.

The products of PCR reactions are analyzed by separation in agarose gels followed by ethidium bromide staining and visualization with UV transillumination. Alternatively, radioactive dNTPs can be added to the PCR in order to incorporate label into the products. In this case the products of PCR are visualized by exposure of the gel to x-ray film. The added advantage of radiolabeling PCR products is that the levels of individual amplification products can be quantitated.

The terms "recombinant construct", "expression construct" and "recombinant expression construct" are used interchangeably herein. These terms refer to a functional unit of genetic material that can be inserted into the genome of a cell using standard methodology well known to one skilled in the art. Such construct may be itself or may be used in conjunction with a vector. If a vector is used then the choice of vector is dependent upon the method that will be used to transform host plants as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., (1985) *EMBO J.* 4:2411–2418; De Almeida et al., (1989) *Mol. Gen. Genetics* 218:78–86), and thus that multiple events must be screened in order to obtain lines displaying the desired expression level and pattern. Such screening may be accomplished by Southern analysis of DNA, Northern analysis of mRNA expression, Western analysis of protein expression, or phenotypic analysis.

The term "ryanodine receptor" as used herein refers to an internal calcium (Ca or $Ca^{++}$) release channel-receptor associated with the endoplasmic/sarcoplasmic reticulum. While these channels are known to exhibit selectivity for calcium ions, other cations such as, but not limited to, potassium can permeate through these channels. The terms "ryanodine receptor", "ion channel receptor", "ion channel", and "ryanodine-like receptor" are meant to encompass the family of ion-channel membrane proteins of the present invention. The terms are used interchangeably herein. The ryanodine receptor does not necessarily require ryanodine binding activity to serve as an ion channel. Functional ion channels with the characteristics described in the present invention are claimed even when the binding of ryanodine or other compounds may be altered due to amino acid changes in the protein sequence. The binding of other non-ryanodine compounds by the ryanodine receptor may occur at the same, or different, regions of the ryanodine receptor.

The term "toxic nucleic acid fragment", "toxic ryanodine receptor nucleic acid fragment", or "toxic insect ion channel" refers to an isolated nucleic acid fragment or subfragment thereof which when present in an organism causes the growth and/or survival of the organism to be compromised. Toxicity may be due to the isolated nucleic acid fragment itself, an RNA that is transcribed from the isolated nucleic acid fragment or a protein which is translated from an RNA derived from the isolated nucleic acid fragment. The growth defect caused by the gene may be alleviated by a mutation within the isolated nucleic acid fragment or subfragment thereof that modifies that part of the gene that causes the toxicity. In this case, growth impairment may be entirely relieved, but the original gene is still considered toxic because growth impairment was only relieved by the modification of the isolated nucleic acid fragment.

The present invention relates to an isolated nucleotide fragment comprising: a nucleic acid sequence encoding a ryanodine receptor having an amino acid sequence identity of at least 75% when compared to a polypeptide selected from the group consisting of SEQ ID NO:2, 4, 6, 8, 10, 128, 130, 144, and 146; or the complement thereof.

In a preferred embodiment, the amino acid sequence identity can be at least 80%, 85%, 90%, 95% or 100% or any integer percentage from 80% to 100%.

The isolated nucleic acid fragment encoding a ryanodine receptor which is modulated by ryanodine alkaloids and anthranilamide insecticides has been isolated from the lepidopteran, tobacco budworm (*Heliothis virescens*, five isoforms) and three homopteran insects, cotton melon aphid (*Aphis gossypi*) corn plant hopper (*Peregrinus maidis*) green peach aphid (*Myzus persicae*), and fruit fly (*Drosophila melanogaster*). Heretofore, the full-length nucleic acid sequence or amino acid sequence of the ryanodine receptor from tobacco budworm, a lepidopteran pest species, was not known, nor that there are at least two variants of these nucleic acid sequences. Examples of homopteran sequences from cotton melon aphid, corn plant hopper, and green peach aphid were also unknown previous to the disclosure in the present invention. The fruit fly sequence is a new varient that differs from all previously disclosed nucleic acid sequences encoding a *Drosophila* ryanodine receptor.

Nucleic acid fragments were isolated from these pest species using PCR and their DNA and amino acid sequence as described below in the Examples. The use of these genes for the development of assays to screen for other insecticides with similar modes of action is described. Use of the isolated nucleic acid fragments, subfragments thereof or the polypeptide encoded by these fragments for insecticidal applications is also disclosed.

The isolated nucleic acid fragments can be expressed in cells to provide a functioning ryanodine receptor that responds to the presence or absence of modulators of calcium homeostasis. This would provide a basis to screen for compounds that activate the release of internal calcium stores, block their release or like ryanodine, hold the ion channel in an open configuration at particular concentrations, yet block the channel at elevated concentrations.

Thus, in another embodiment the present invention concerns a method for evaluating at least one compound for its ability to modulate calcium homeostasis, the method comprising the steps of:

(a) transforming a host cell with a recombinant construct as described herein;
(b) growing the transformed host cell under conditions that are suitable for expression of the recombinant construct wherein expression of the recombinant construct results in altered calcium homeostasis;
(c) treating the transformed host cell of step (a) with a compound to be tested; and
(d) determining changes in intracellular calcium homeostasis by the test compound in order to select compounds with potential for altering calcium release.

"Modulation" as used herein refers to the alteration of the function of activity of the protein, in this case, alteration of calcium homeostasis or as mentioned below, alteration of ryanodine receptor activity.

In still a further embodiment, this invention concerns a method for evaluating at least one compound which modulates ryanodine receptor activity, the method comprising the steps of:

(a) contacting at least one compound with a polypeptide encoded by an isolated nucleic acid fragment of the invention; and
(b) evaluating the ryanodine receptor activity of the polypeptide of (a) after said polypeptide has been contacted with the compound or compounds.

The ryanodine receptor from a variety of species is functional as a homotetramer of subunits each one being about 0.5 MDa in size. The C-terminal 20% of the protein forms the membrane spanning region that constitutes the channel through which calcium ions flow into the cytosolic milieu from internal calcium stores (Bhat et al. (1997), Biophys J 73:1329–36). The remaining 80% of the protein on the cytosolic side of the membrane interacts with a number of other proteins and cellular low molecular weight components. The effects of these components is to modulate calcium flow by favoring the 'open' or 'closed' state of the channel thus the release of calcium and the balance of the ion in the cytosol relative to internal stores.

The effect of interfering with the calcium balance particularly in muscle tissue is to disrupt the normal processes involved in contraction and relaxation, i.e. excitation-contraction coupling (ECC). For example, mutations in the human cardiac ryanodine type 2 receptor have been implicated in sudden cardiac arrest syndrome (Marks et al (2000) *Cell* 101:365–76) and malignant hypothermia (Tong et al (1997) *J Biol Chem* 272:26322–26326).

While ryanodine has been used as a natural insect control agent, the structural complexity of the compound has prevented significant commercialization. It would be desirable to identify easily synthesized small compounds, possessing insecticidal activity, that stimulate the release of internal calcium stores via interaction with the ryanodine receptor complex.

Other small molecules that have been found to interact with the ryanodine receptor are those based on an anthranilamide structure. Examples of these molecules termed "GN analog" compounds are shown in FIG. 2 and their use is outlined in Examples 9 and 11. It is envisioned that many types of chemistry and derivatives may be useful in altering the function of the ryanodine receptor complex. While the overall effect on the organism is comparable to that of ryanodine, namely lethargy and paralysis, these other molecules differ in their mode of action from ryanodine by opening calcium release channels. This channel activation leads to depletion of calcium stores whereas ryanodine acts by locking channels in a sub-conductance state. The binding site of these "GN" molecules has also been found to be different than that of ryanodine. Nonetheless, the ability of these molecules to release calcium stores in recombinant cell lines expressing insect ryanodine receptors, as shown in FIGS. 3 and 4, but not in control cell lines lacking these ryanodine receptors, lends further support that the ryanodine receptor protein itself is the binding site of "GN" chemistry.

Based on the effects of this structural class of compounds it is clear that the ryanodine receptor is a valuable biochemical target for the discovery of new pesticides. Like other insect ion channels and receptors, there are potentially multiple binding sites on the protein that could influence the functional properties of the channel-receptor and thus cellular calcium balance. In addition to small molecule binding sites, numerous proteins interact with the receptor on both sides and within the reticulum membrane (see Mackrill, (1999) *Biochem. J.* 337: 345–361 for a review). Compounds found to interfere with these interactions could also be useful as pesticides.

The Ryr gene from invertebrates is expressed widely in all muscle types and in neurones and so accessibility to active compounds would be expected. Symptomology of the mode of action of the anthranilamides is consistent with a direct effect of these compounds on all the muscle cells of the insect, skeletal, smooth and cardiac. Fluorescence imaging analysis of roach neuronal cells or binding studies using roach leg muscle indicates that there is a close correlation between calcium influx in neurons, or binding to leg muscle preparations, and the activity of these compounds in insect pest screens.

Tissue preparations from muscle and neuronal cells are thus sources of the insect receptor for isolation and binding studies. Selection of the most appropriate cells can be achieved using, e.g. the binding affinity of a radiolabeled analog of the chemistry being investigated or radiolabeled ryanodine, which is commercially available. Binding studies using radioactive ryanodine and GN analogs are presented in Example 9. This might be determined in a number of ways, which could include but not be limited to the fate of a radiolabeled analog during receptor preparation, or monitoring a specific spectroscopic characteristic of the analog or its derivative. Quality of preparations might be assessed based on the intensities of fluorescence from calcium flux induced by specific receptor modulators, such as caffeine, as detected using calcium specific fluorescence indicators. Examples of indicators useful for monitoring changes in intracellular calcium include FURA-2, Fluo-3, and Fluo-4 but other compounds exist that are well known and would be useful alternatives. Alternatively, preparations can be assessed based on the quantity of functional receptor per unit weight of tissue determined from the amount of radiolabelled ligand that is bound.

Unfortunately tissue samples are not available from all pests of interest in quantities necessary for effective screening or analysis. Therefore, a significant advantage of working with recombinant material is the ability to express a single variant of any gene in many cellular types and backgrounds and thus produce homogeneous experimental preparations in relatively controlled amounts depending on the choice of promoter. A further advantage is that species specific receptors often have unique binding sites, thus a recombinant system offers flexibility in terms of which source of the gene is chosen for expression. This provides a means of comparative analysis of the response of the system in various pre-selected conditions.

Pest receptors in enough quantities from any of these sources, would form the basis of assays that have utility for identifying other synthetic compounds or natural ligands that have the same mode of action. In the case of an assay based on monitoring of intracellular calcium concentration, modulators that cause activation of the ion channel or its blockage can be identified. A binding assay can be used to identify those modulators that interact with the receptor or ion channel at the specific site where the labeled analog binds or at allosteric sites which alter the binding of the analog.

In binding assays one partner molecule is immobilized and the other is labeled in some fashion (e.g. using a nonradioactive label such as an enzyme or fluorescent tag or by using a radioactive label) and added free in solution. After incubation to allow molecular interaction, and a wash step, the amount of ligand bound is measured using an appropriate detection system. Ligands showing significant binding may then be studied further by ensuring that the protein is in excess, and carrying out experiments with a dilution series of the ligand at a set of known concentrations, typically from $10^{-2}$ to $10^{-10}$M.

Proteins may be immobilized using an epitope or other affinity tag on a support material to which an appropriate antibody or binding agent for the tag is attached. For example, members of specific binding pairs can be of the immune or non-immune type. Immune specific binding pairs are exemplified by antigen/antibody systems or hapten/antihapten systems. The antibody member, whether polyclonal or monoclonal or an immunoreactive fragment thereof, of the binding pair can be produced by customary methods familiar to those skilled in the art. The terms immunoreactive antibody fragment or immunoreactive fragment mean fragments which contain the binding region of the antibody. Such fragments may be Fab-type fragments which are defined as fragments devoid of the Fc portion, e.g., Fab, Fab' and $F(ab')_2$ fragments, or may be so-called "half-molecule" fragments obtained by reductive cleavage of the disulfide bonds connecting the heavy chain components of the intact antibody. If the antigen member of the specific binding pair is not immunogenic, e.g., a hapten, it can be covalently coupled to a carrier protein to render it immunogenic.

Non-immune binding pairs include systems wherein the two components share a natural affinity for each other but are not antibodies. Exemplary non-immune binding pairs are biotin-avidin or biotin-streptavidin, folic acid-folate binding protein, complementary nucleic acid probes, etc. Also included are non-immune binding pairs which form a covalent bond with each other. Exemplary covalent binding pairs include sulfhydryl reactive groups such as maleimides and haloacetyl derivatives and amine reactive groups such as isothiocyanates, succinimidyl esters, sulfonyl halides and coupler dyes such as 3-methyl-2-benzothiazolinone hydrazone (MBTH) and 3-(dimehtyl-amino)benzoic acid (DMAB), etc.

Suitable supports used in assays include, but are not limited to, synthetic polymer supports such as polystyrene, polypropylene, substituted polystyrene. E.g., aminated or carboylzted polystyrene; polyacrylamides; polyamides; polyvinylchloride, etc.; glass beads; agarose; nitrocellulose; nylon; polyvinylidenedifluoride; surface-modified nylon, etc.

One further example of an affinity tag is a photoaffinity label that is an analog of a tight binding modulator or effector and might be used to covalently label residues of the receptor that compose the binding site of the effector. The small analog not only has been altered to covalently modify the protein using light irradiation to activate the affinity moiety but also carries a radioactive label for further convenient identification of the region of the receptor that has been modified. Futher analysis of the labeled receptor or peptide fragments that carry the modified residues can lead to identifying the region of the protein that comprises the analog binding site.

Functional assays for the identification of low molecular weight compounds and natural products that modulate calcium homeostasis through their action on the receptor directly, or through their affect on attendant proteins involved in the process of calcium signaling have been developed (Mackrill et al. (1999) *Biochem J* 337:345–361). Additional methods include, but are not limited to, planar lipid bilayer recording, and imaging and fluorometric monitoring of in situ calcium concentration changes (Brillantes et al. (1994) *Cell* 77:513–523; Mack et al. (1994) *J Biol Chem* 269:23236–23249; Chen et al. (1999) *J Biol Chem* 274: 32603–32612; Rodney et al. (2001) *Biochemistry* 40:12430–12435)

There are many ways that a nucleic acid fragment encoding a ryanodine receptor might be used once it has been first isolated and then cloned into a suitable vector. Methods for isolating such nucleic acid fragments include, but are not limited to, isolating the RNA from cells that are known to express the native Ryr protein. In this case the tissue source was from lepidopteran and homopteran pests. Other pests might include, but are not limited to, all those from the invertebrate kingdom and parasitic pathogens, e.g. those causing animal health problems or considered household pests. Examples of such pests include but are not restricted to, fleas, ticks, roaches, mosquitos, nematodes, Plasmodium falciparum, sheep blowfly.

RNA could then be used, if enough DNA sequence were available to design and synthesize oligonucleotide primers and then those skilled in the art use these primers to generate DNA by RT PCR. The sequence of the DNA is therefore valuable for allowing primers to be designed that will allow the receptor gene to be isolated from a wide range of other invertebrates. The gene might be generated in toto if the primers are designed from the extreme 5'- and 3'-regions of the gene. Alternatively, the gene might be built from a number of sub-fragments isolated after RT PCR of internal regions of the gene. In this case acquiring regions at the extreme ends of the gene may be challenging and then procedures like 5'-RACE or inverse PCR may need to be employed. The RNA could be total or fractionated material to enrich some specific type such as mRNA. The RNA might be generally expressed and amplified in a number of ways to generate e.g. a cDNA library, or variant of library production that would capture all versions of the gene, if more than one exists.

Alternatively the isolated nucleic acid fragment of the invention could be extracted from complete cells, cell lysates sub-cellular components and purified from other cellular material. In the case of nuclear material, the nucleic acid fragment will be genomic and thus likely to contain many introns which may offer the ability to provide alternative sequence arrangements and thus different variants of the functional protein. This nucleic acid fragment might be used to generate a BAC, cosmid, fosmid or other variation of a genomic library to ensure all variants of the exons and introns of the gene are available.

The nucleic acid fragment coding for the native gene, chimeric or mutagenic variants or subfragments thereof might also be synthesized chemically using the known sequence as offered by a number of commercial enterprises.

Sequences of other utility outside the ORF (open reading frame) or internal to the ORF might also be considered, such as specific promoters for transcription control, precursor sequences for targeting to particular cellular compartments, or for post-translational modification or for altering the interactions of the receptor and ion channel with its membrane, secondary messengers, or attendant proteins also involved, directly or indirectly in calcium homeostasis. Fusion of the nucleic acid fragment with other ORFs that encode reporter proteins e.g. GFP, luciferase have application for assisting in localization of the gene product in the cell, or for assessing production of the receptor. In another example, domains of beta-galactosidase can be fused to different proteins suspected of interacting with the receptor. The interaction between the receptor and the fusion protein can then be investigated using the beta-galactosidase activity as an assayable reporter.

RNA transcribed from the native gene or any variant, chimeras, precursors either in vivo or in vitro would be useful in a number of applications e.g. in vitro translation to produce the mature protein, a precursor or sub-fragments to study further the function in calcium homeostasis and cell signaling. Sub-fragments of the protein generated in vitro could have utility for producing antibodies (Chen et al (1993) *J Biol Chem* 268:13414–21) or biochemical analysis to identify ligand or attendant protein binding sites (Callaway et al (1994) *J Biol Chem* 269:15876–84).

The sequence of the protein is valuable for designing antibodies that are either specific for a particular variant of the receptor or alternatively using those areas of homology, generally cross react with many forms of the receptor. An additional use of the protein sequence is to identify regions that are susceptible to digestion by specific proteases. Digestion of the protein into subfragments with or without bound molecules would allow the sites where these molecules bind to be mapped. Understanding the nature of the receptor binding sites of small organic molecules could be used to apply a number of different computational modeling approaches to design other small molecules that target the same site and may have other desired biological and ecotoxicological activities and attributes.

Receptor isolated from any source may be post-translationally modified, processed, proteolytically cleaved to form sub-fragments that are separate or still associated with the body of the protein and still be functional. Because the genomic DNA is likely to be composed of multiple exons and introns there is a possibility of one gene producing different receptor-ion channel types due to alternate spliced versions of the messenger RNA. These different subtypes may have different functional properties in calcium homeostasis.

The isolated nucleic acid fragment or its variants may be cloned into any suitable vector, such as, but not limited to, plasmids, virus or binary vectors for infection purposes. The isolated nucleic acid fragment could be coupled to a multiplicity of promoter sequences that allow transcription and translation in the relevant bacterial, yeast, plant, oocyte, insect, or mammalian cell hosts either constitutively or in response to defined conditions. Selection of those cells expressing the recombinant receptor would be identified by their perturbation of ryanodine receptor function detected through changes in calcium dependent fluorescence (see Example 9 for details), or ion channel conductance, and these used for screening purposes or for further investigation of the components that are involved in calcium homeostasis and signalling. The cells would also be a source of the functional receptor for further biochemical work. Results from such work would include, but not be limited to, fractionation and purification of the protein, subfragment analysis for binding domain characterization, swapping of domains encoding regions from different ryanodine receptors to form chimeric receptor proteins, mutagenesis of the receptor to isolate isoforms that have altered ion channel activity, and mutagenesis of the receptor to isolate isoforms that have altered ryanodine or GN binding.

In another aspect, this invention concerns an isolated nucleotide fragment selected from the group consisting of SEQ ID NO: 1, 3, 5, 7, 9, 127, 129, 143, and 145. Also, of interest is the complement of this isolated nucleotide fragment.

In still another aspect, this invention concerns recombinant DNA constructs comprising any of the above-identified isolated nucleic acid fragments or complements thereof or parts of such fragments or complements operably linked to at least one regulatory sequence. These recombinant DNA constructs are useful for the purpose of over-expression, antisense inhibition, or co-suppression of ryanodine receptor activity in a transformed host cell.

Also, of interest are eukaryotic or prokaryotic host cells comprising such chimeric constructs in their genome. Useful host cells include, but are not limited to, *E. coli*, yeast, Sf9, Sf21, S2, Xenopus oocytes, HEK293, and CHO.

The cDNAs encoding the instant polypeptides may be introduced into the baculovirus genome itself, using standard methods of cloning and transformation (see Example 5 for details). The *Spodoptera frugiperda* cell lines Sf9, Sf21, or the *Drosophila* S2 cell lines can be used for transfection studies. The supernatant fluid from co-transfection experiments may be used to isolate recombinant virus and/or expressed protein (see Example 5).

In addition to the above discussed procedures, those skilled in the art are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., Molecular Cloning: A Laboratory Manual, Cold Spring Harbor Press (1989); Maliga et al., Methods in Plant Molecular Biology, Cold Spring Harbor Press (1995); Birren et al., Genome Analysis: Detecting Genes, 1, Cold Spring Harbor, N.Y. (1998); Birren et al., Genome Analysis: Analyzing DNA, 2, Cold Spring Harbor, N.Y. (1998); Plant Molecular Biology: A Laboratory Manual, eds. Clark, Springer, N.Y. (1997)).

In a still further aspect this invention concerns a method to isolate nucleic acid fragments encoding ryanodine receptors and related polypeptides, comprising:
  (a) comparing SEQ ID NO:2, 4, 6, 8, 10, 128, 130, 144, and 146 and other ion channel and receptor polypeptide sequences;
  (b) identifying the conserved sequences of 4 or more amino acids obtained in step a;
  (c) designing degenerate oligomers based on the conserved sequences identified in step b; and
  (d) using the degenerate oligomers of step c to isolate sequences encoding polypeptides having ryanodine receptor activity by sequence dependent protocols.

In another aspect, this invention concerns an isolated polypeptide having ryanodine receptor activity, wherein the amino acid sequence of the polypeptide and the amino acid sequence of SEQ ID NO:2, 4, 6, 8, 10, 128, 130, 144, and 146 have at least 75%, 80%, 85%, 90%, 95%, or 100% identity. One skilled in the art would realize that any integer percent identity from 75% to 100% would be useful in identifying ryanodine receptor-like polypeptide sequences.

In another embodiment, this invention concerns a method for evaluating at least one compound for its ability to modulate calcium homeostasis, the method comprising the steps of:
  (a) transforming a host cell with any one of the aforementioned recombinant constructs, or any recombinant construct containing any one of SEQ ID NOs:56–62;
  (b) growing the transformed host cell under conditions that are suitable for expression of the recombinant construct wherein expression of the recombinant construct results in altered calcium homeostasis;
  (c) treating the transformed host cell of step (a) with a compound to be tested; and
  (d) determining changes in intracellular calcium homeostasis by the test compound in order to select compounds with potential for altering calcium release.

This method wherein the method can be, but is not limited to, a ligand binding assay. Furthermore, this method can be based on assessing functional activity by detecting the effect of a compound on the functional activity of the transformed host cell or ion channels obtained from such cells.

In a further embodiment, this invention concerns a method for evaluating at least one compound which modulates ryanodine receptor activity, the method comprising the steps of:
  (a) contacting at least one compound with a polypeptide encoded by any one of the aforementioned isolated nucleic acid fragments; and
  (b) evaluating the ryanodine receptor activity of the polypeptide of (a) after said polypeptide has been contacted with the compound or compounds.

This method wherein the method can be, but is not limited to, a ligand binding assay. Furthermore, this method can be useful wherein the polypeptide is contacted with more than one compound.

Insect specific sequences can be identified by finding homologous subsequences that are conserved between all of the insect sequences but not among the non-insect sequences. A number of these sequences can be found in SEQ ID NOs:63–119. Prior to the characterization of the sequences presented herein insect specific sequences could not be identified since the fruitfly sequence was the only insect sequence available and this had very low (less than 50%) homology to the animal ryanodine receptor sequences.

A further embodiment of the present invention would be an isolated nucleic acid fragment encoding an insect ion channel comprising at least two polypeptide sequences set forth in any of SEQ ID NOs:63–119 provided that said polypeptide sequences do not comprise any of SEQ ID NOs:56, 120–126.

Yet another embodiment would be a method for identifying a nucleic acid sequence encoding an insect ion channel comprising:
  a) obtaining an isolated nucleic acid sequence encoding a first polypeptide having at least 100 amino acids;
  b) comparing the first polypeptide sequence with a comparative polypeptide sequence selected from the group consisting of SEQ ID NOs:63–119 to identify a region between the first polypeptide and the comparative polypeptide having 100% sequence identity wherein said region is as long as the comparative polypeptide; and
  c) repeating step (b) with a different comparative polypeptide sequence, wherein said different comparative polypeptide sequence is selected from the group consisting of SEQ ID NOs:63–119 until a second region having 100% sequence identity is found, wherein said second region is as long as the different comparative polypeptide. The method could be further characterized by the length of the first polypeptide having a length of from 100 to 6,000 amino acids.

Yet a further embodiment of the present invention would be a method for expressing an isolated nucleic acid fragment encoding a toxic insect ion channel comprising:
  a) transforming a host with a recombinant construct comprising in the 5' to 3' direction a promoter operably linked to the toxic insect ion channel nucleic acid, wherein the promoter comprises a transcription termination nucleic acid fragment, and/or an in-frame translation stop codon, situated between said promoter and the isolated nucleic acid fragment encoding the toxic insect ion channel, and further wherein the transcription termination nucleic acid fragment, and/or an in-frame translation stop codon, is flanked on each end by at least one nucleic acid sequence consisting essentially of excisable sequences; and
  b) growing the transformed host under conditions that are suitable for the expression of the recombinant construct. The excisible sequences may be any sequences recognized by recombinase enzymes, such as but not limited to, lox sites.

A related embodiment of the present would encompass the recombinant constructs themselves comprising in the 5' to 3' direction a promoter operably linked to an isolated nucleic acid fragment encoding a toxic insect ion channel, wherein the promoter comprises a transcription termination nucleic acid fragment, and/or at least one in-frame translational termination codon, situated between said promoter and the isolated nucleic acid fragment encoding the toxic insect ion channel, and further wherein the transcription termination nucleic acid fragment, and/or at least one in-frame translational termination codon, is flanked on each end by at least one nucleic acid sequence consisting essentially of excisable sequences. The excisible sequences may be any sequences recognized by recombinase enzymes, such as but not limited to, lox sites.

Another embodiment of the present invention would be a method for expressing an isolated nucleic acid fragment encoding a toxic insect ion channel comprising:
  a) transforming a host with a recombinant expression construct comprising in the 5' to 3' direction a promoter operably linked to an isolated nucleic acid fragment encoding the toxic insect ion channel, wherein said fragment also comprises an intron which interferes with expression of said fragment, and
  b) growing the transformed host under conditions that are suitable for the expression of the recombinant construct.

In still another embodiment, the present invention would encopass a recombinant expression construct comprising in the 5' to 3' direction a promoter operably linked to an isolated nucleic acid fragment encoding a toxic insect ion channel wherein said isolated nucleic acid fragment also comprises an intron which interferes with expression of the toxic insect ion channel.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The disclosure of each reference set forth herein is incorporated herein by reference in its entirety.

Example 1

Isolation of Ryanodine Receptor Nucleic Acid Fragment From Tobacco Budworm

Total RNA was extracted from 2 g of $4^{th}$ and $5^{th}$ instar tobacco budworm larvae that had been flash frozen in liquid N2 and ground to a powder in a chilled mortar. The powder was extracted with 20 ml of TriZOL™ by vigorous shaking for 15 s and then incubation of the sample at 30 C for 3 min. Two ml of chloroform was added and the shaking and incubation treatment repeated. The sample was spun at 12,000 g for 10 min at 8° C. and the aqueous phase transferred to a fresh tube. 5 ml of isopropyl alcohol and 5 ml of 0.8 M sodium citrate containing 1.2 M NaCl was mixed with the aqueous fraction and after 10 min at room temperature the sample was centrifuged a second time. The pellet was washed with 10 ml of 70% EtOH, the suspension recentrifuged at 7500 g for 5 min and the resulting pellet allowed to dry before dissolving in 2 ml water. OligoT primed cDNA synthesis used this total RNA as template and following the protocols that accompanied the cDNA synthesis kit purchased from Invitrogen™.

The isolated nucleic acid fragment encoding the tobacco budworm ryanodine receptorwas cloned using a PCR based protocol (SEQ ID NO:1). Only the last 4056 bases of the 3'-end of the coding region is available from public databases. To acquire the complete transcript meant designing oligonucleotide primers for regions of the transcript as close to the 5'-end as feasible. From an analysis of DNA sequence similarities of the receptor from *Drosophila melanogaster* and *Caenorhabditis elegans*, as well as comparison with other mammalian species, the following degenerate primers were designed and synthesized for this purpose:

| | | |
|---|---|---|
| A-F1: | CCTGARGCNYTNAAYATGAT | (SEQ ID NO: 11) |
| A-F2: | GATCCTAARGTNYTNGAYGT | (SEQ ID NO: 12) |
| A-F3: | AAGTGGTAYTTYGARTTYGA | (SEQ ID NO: 13) |
| A-R1: | TCGAAYTCRAARTACCAYTTNCC | (SEQ ID NO: 14) |
| A-R2: | AATGGYTCRTANCCYTCYTG | (SEQ ID NO: 15) |

The 'A' designated primers cover a region of the sequence approximately 1722 nucleotides to 3702 nucleotides from the 5'-end (SEQ ID NO:1). All combinations of forward and reverse primers were used to amplify this putative region of the gene. PCR was carried out using 4 μM of each of the primers, dNTPs (200 μM), with 1 μl cDNAs and subjected to 35 cycles of PCR. The PCR conditions were 94° C. for 15 sec, 45° C. for 30 sec and 72° C. for 1 min. The primer combinations that produced a fragment of the expected size were A-F2/A-R2 and A-F3/A-R2. The amplified bands were purified from a 1.5% agarose gel and subcloned into a pDrive® TA cloning vector (Qiagen™) following standard protocols supplied with the kit. Subsequent sequencing of the PCR product confirmed that this region of the gene between nucleotides 1722 to 3702 (SEQ ID NO:1) had been successfully located when compared to the *Drosophila* sequence.

A similar approach was used to identify a region of the gene close to the extreme 5'-end between nucleotides 27 and 1443.

| | | |
|---|---|---|
| D-F1: | GAGCAGGAYGAYGTNWSNTT | (SEQ ID NO: 16) |
| D-F2: | GCTGCTGARGGNTTYGGNAA | (SEQ ID NO: 17) |
| D-F3: | GGTGARGCNTGYTGGTGGAC | (SEQ ID NO: 18) |
| D-R1: | GTCCACCARCANGCYTCNCC | (SEQ ID NO: 19) |
| D-R2: | ACTCKTACYTTYTCNCCYTC | (SEQ ID NO: 20) |
| D-R3: | GGTATTGTTARRCAYTCRTC | (SEQ ID NO: 21) |
| D-R4: | TTTAGTACNCCYTCYTCYTGRAA | (SEQ ID NO: 22) |

Nearly all combinations of forward and reverse primers were involved in the initial round of amplification and putative PCR products were immediately subjected to a second, or 'nested' round of amplification. In this case 1/100th volume of the product of the first round was used as a template along with the same cycling conditions. Using this approach it was found that D-F1/D-R3, nested with D-F1/D-R2; DF2/D-R3 followed by D-F3/D-R3 and D-F2/D-R4 followed by D-F3/D-R3 produced bands of the expected size on an agarose gel. The bands were isolated and their sequence compared to the *Drosophila* sequence.

These regions of sequence indicate that more than 99% of the isolated nucleic acid fragment could be recovered from the cDNA preparation and the only segment missing was the starting 24 bases of the 5'-region. To obtain this section and complete the gene, a 5' RACE procedure was used as described by Clontech™ in their Marathon® Amplification kit.

WL3: CACACACTGCGACAGATCAGGCGG (SEQ ID NO:23)

WL4: GCAATATTCTCCAGGAAGCAGTGCCG (SEQ ID NO:24)

Based on this full-length sequence, new primers were designed:

pHVN3-PacI: GCCAAGTTAATTAACCATGGCGGAAGCAGAGGGGGAG (SEQ ID NO: 25)

pRhC1-PmeI: GGACTCGTTTAAACGATTCTCCCATGAGGTCTTCGTATTGC (SEQ ID NO: 26)

These primers were used for long PCR reactions following the protocol in the Expand Long Template PCR System® kit supplied by Roche™. A two stage PCR protocol was used that first used the following reaction conditions 94° C. for 5 minutes and then 10 cycles of 10 sec at 92° C. followed by 68° C. for 14 min. The next stage was 15 cycles of 10 sec at 92° C., followed by 68° C. for 14 min with each cycle incremented by 20 sec producing the full-length isolated nucleic acid fragment with PacI and PmeI unique restriction sites at the 5' and 3' ends respectively.

A 15.6 Kb DNA fragment was cloned into a pCR-XL-TOPO® vector of Invitrogen™. The complete sequence for *H. virescens* Ryr transcript was obtained by standard sequencing method using plasmid and PCR products.

Sequences for cDNAs encoding ryanodine receptor proteins can also be identified by conducting BLAST searches. (Basic Local Alignment Search Tool; Altschul et al. (1993) *J. Mol. Biol.* 215:403410) searches for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL, and DDBJ databases). The cDNA sequences obtained in Example 1 were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States (1993) Nat. Genet. 3:266–272) provided by the NCBI. For convenience, the P-value (probability) of observing a match of a cDNA sequence to a sequence contained in the searched databases merely by chance as calculated by BLAST are reported herein as "pLog" values, which represent the negative of the logarithm of the reported P-value. Accordingly, the greater the pLog value, the greater the likelihood that the cDNA sequence and the BLAST "hit" represent homologous proteins.

Example 2

Reconstruction of the Ryanodine Receptor Isolated Nucleic Acid Fragment from Green Peach Aphid Total RNA was extracted from 0.5 g of green peach aphid (*Myzus persicae*) or any Homopteran species flash frozen in liquid N2 and ground to a powder in a chilled mortar. The powder was extracted with 20 ml of TriZOL® by vigorous shaking for 15 s and then incubation of the sample at 30 C for 3 min. Two ml of chloroform was added and the shaking and incubation treatment repeated. The sample was spun at 12,000 g for 10 min at 8 C and the aqueous phase transferred to a fresh tube. 5 ml of isopropyl alcohol and 5 ml of 0.8 M sodium citrate containing 1.2 M NaCl was mixed with the aqueous fraction and after 10 min at room temperature the sample was centrifuged a second time. The pellet was washed with 10 ml of 70% EtOH, the suspension recentrifuged at 7500 g for 5 min and the resulting pellet allowed to dry before dissolving in 2 ml water.

The same combination of the 'D' set of forward and reverse primers that successfully produced the 5'-sequences of the tobacco budworm gene were used as described before. A second set of primers to acquire most of the 3' region were also designed from regions of high homology for all the known ryanodine receptor sequences.

```
E-F1    GGAGGTGGNATHGGNGAYGA    (SEQ ID NO: 27)
E-F2    ATCATCGAYGCNTTYGGNGA    (SEQ ID NO: 28)
E-R1    AARCARTCNCCNACNGGRAA    (SEQ ID NO: 29)
E-R2    ACNGGRAARAARTCCCARCA    (SEQ ID NO: 30)
```

The bands generated using the D-F and D-R combinations as well as the E-F and E-R combinations produced sequence consistent with their expected origin as segments of the receptor isolated nucleic acid fragment. The remaining sequences for the extreme 5' and 3'-ends were obtained using RACE procedures as described in Example 1 employing the following 5' RACE primers

```
F-R1:   CCCTCTTGAGAACTTGCAGCTGTCAC    (SEQ ID NO: 31)
F-R2:   CGTCCGGTGTCCAGATCCAGTTCCGCC   (SEQ ID NO: 32)
F-R3:   GATGAACAGTCCACCAACAAGCTTCAC   (SEQ ID NO: 33)
``` and 3' RACE primers

```
G-F1:   GCTGGAAAGCGTCAAGGAAGACATGG    (SEQ ID NO: 34)
G-F2:   GCGGTATCGGCAAAGATTATTTCGAC    (SEQ ID NO: 35)
G-F3:   GTGCCGCATGGTTTCGACACTCACG     (SEQ ID NO: 36)
```

The sequences of the RACE products were used to design primers to incorporate the PmeI and PacI unique restriction sites outside the starting and stop codon of the full-length coding region of the ryanodine receptor.

The primers used were:

```
pRgN-PacI:  GCCAAGTTAATTAACGATGGCCGACAGCGAGGGCAGTTCG    (SEQ ID NO: 37)
pRgC-PmeI:  GGACTCGTTTAAACGAGACGCCTCCTCCGCCGCCGAGC      (SEQ ID NO: 38)
``` the full-length cDNA for the gene was thus isolated with PacI and PmeI sites at the 5' and 3' ends respectively.

The 16 kb PCR product was cloned into a pCR-XL-TOPO™ vector (Invitrogen Life Technologies™, Carlsbad, Calif.) and the full-length ryanodine receptor coding region subsequently sub-cloned into pIBV5His or pFASTBac vectors modified between the BamHI and XbaI sites of the MCS of the vector with PacI and PmeI sites (SEQ ID NO:39).

Full-insert sequencing was achieved using a combination transposon and primer walking procedure. The transposon system used was the EZ::TN transposon insertion kit from Epicentre™ using the TET 1 version of the transposon (Goryshin and Reznikoff (1998) *J Biol Chem* 273:7367–7374). 200 clones were isolated to provide 380 sequences using forward and reverse primers supplied in the kit. Primers were then designed from these regions to fill in the gaps by gene walking. The sequence of the green peach aphid gene is shown in SEQ ID NO:3.

Example 3

Reconstruction of the Ryanodine Receptor Isolated Nucleic Acid Fragment from Cotton Melon Aphid and Corn Plant Hopper cDNA for the ryanodine receptor coding regions from cotton melon aphid and corn plant hopper were obtained essentially as described in Example 2. The same D primer set used in Example 1 and E primer set used in Example 2 produced nearly the full-length sequence for the two homopteran species. The following primers were used for a RACE series of experiments to produce the sequences of the 5' and 3' ends of the ryanodine receptor coding regions. For cotton melon aphid the 5'RACE primers used were

```
CMA-DR1:  GCTGGATGCACAGTCCACCAACAAGCTTC   (SEQ ID NO: 40)
CMA-DR2:  CAATGTTCGGTGTCCAGATCCAGTTCC     (SEQ ID NO: 41)
CMA-DR3:  GACGGGTACACACTGAGACAAGTCGGGTGG  (SEQ ID NO: 42)
``` and 3' RACE primers

```
CMA-EF1: CTGCGGCATCGGCAAAGATTATTTCG (SEQ ID NO: 43)
CMA-EF2: CCGCACGGTTTTGACACGCACGTTC  (SEQ ID NO: 44)
CMA-EF3: CCGGCCAAGAAACGTACGTCTGGAAC (SEQ ID NO: 45)
```

For corn plant hopper the 5' RACE primers were

```
CPH-DR1:  CCGAAGCACATCGCCACCAAACAC   (SEQ ID NO: 46)
CPH-DR2:  CCTGTGCCATAAGGCTGAACGGACC  (SEQ ID NO: 47)
```

-continued

| | | |
|---|---|---|
| CPH-DR3: | CGTCACCAACTCGCACCTTCTCACCCTCC | (SEQ ID NO: 48) | and 3' RACE primers

| | | |
|---|---|---|
| CPH-EF1: | GGAAGACATGGAGTCCAACTGTTTCATTTGTGGC | (SEQ ID NO: 49) |
| CPH-EF2: | GTGCCGCATGGTTTCGATACTCATGTGCAGC | (SEQ ID NO: 50) |
| CPH-EF3: | GCATAATCTCGCTAATTACATGTTCTTCCTCATGC | (SEQ ID NO: 51) |

The sequences of the primers designed to incorporate the PacI and Pme sites at the ends of the ryanodine receptor coding regions for the cotton melon aphid are as follows:

| | | |
|---|---|---|
| pRCMAN-Pacl: | GCCAAGTTAATTAACGATGGCCGACAGCGAGGGAAGTTCG | (SEQ ID NO: 52) |
| pRCMAC-Pmel: | GAACTCGTTTAAACGAGACGCCTCCTCCGCCGCCAAGC | (SEQ ID NO: 53) | and those designed to incorporate the PacI and Pme sites at the ends of the ryanodine receptor coding regions for the corn plant hopper are as follows:

| | | |
|---|---|---|
| pRCPHN-Pacl: | GCCAAGTTAATTAACAATGGCGGATAGTGAGGGTGGATCTG | (SEQ ID NO: 54) |
| pRCPHC-Pmel: | GAAGTCGTTTAAACGAGCCACCACCGCCTCCTAACTCATC | (SEQ ID NO: 55) |

Both full-length ryanodine receptor coding regions were again cloned into the pCR-XL-TOPO®) vector (Invitrogen™) and subsequently sub-cloned into the modified pIBV5His or pFASTBac as described in Example 2.

To complete the sequences of the ryanodine receptor coding regions, the inserts in the pCR-XL-TOPO®) vector were digested with a mixture of EcoRI and BamHI restriction enzymes. The fragments were then subcloned into three pBluScript KS vectors, digested either with EcoRI, BamHI or both combined. The vectors were religated in the presence of the mixtures of the ryanodine receptor coding region sub-fragments. About forty individual clones for each of the CMA and CPH ryanodine receptor coding regions were isolated from individual bacterial colonies and the inserts sequenced using vector primers. The gaps remaining in the sequence were completed by gene walking.

Example 4

Characterization of cDNA Clones Encoding Ryanodine Receptors

The BLASTX search using the EST sequences from clones listed in Table 3 revealed similarity of the polypeptides encoded by the cDNAs to the ryanodine receptor protein from *Drosophila [Drosophila melanogaster*] (NCBI General Identifier No. gi 17352471, [SEQ ID NO:56. Shown in Table 3 are the BLAST results for individual ESTs ("EST"), the sequences of the entire cDNA inserts comprising the indicated cDNA clones ("FIS"), the sequences of contigs assembled from two or more ESTs ("Contig"), sequences of contigs assembled from an FIS and one or more ESTs ("Contig*"), or sequences encoding an entire protein derived from an FIS, a contig, or an FIS and PCR ("CGS"):

TABLE 3

BLAST Results for Sequences Encoding Ryanodine Receptors

| Clone | Status | BLAST pLog Score 17352471 |
|---|---|---|
| tobacco budworm | CGS | 180.0 |
| tobacco budworm | CGS | 180.0 |
| tobacco budworm | CGS | 180.0 |
| tobacco budworm | CGS | 180.0 |
| tobacco budworm | CGS | 180.0 |
| green peach aphid | CGS | 180.0 |
| cotton melon aphid | CGS | 180.0 |
| corn plant hopper | CGS | 180.0 |
| fruit fly | CGS | 180.0 |

The data in Table 4 represents a calculation of the percent identity of the amino acid sequences set forth in SEQ ID NOs:2, 4, 6, 8, 10, 128, 130, 144, and 146, and the ryanodine receptor protein from *Drosophila [Drosophila melanogaster*] (NCBI General Identifier No. gi 17352471, SEQ ID NO:56).

TABLE 4

Percent Identity of Amino Acid Sequences Deduced From the Nucleotide Sequences of cDNA Clones Encoding Ryanodine Receptors

| SEQ ID NO. | Percent Identity to 17352471 |
|---|---|
| 2 | 78.5% |
| 128 | 79.2% |
| 130 | 79.3% |
| 144 | 79.0% |
| 146 | 79.3% |
| 4 | 75.7% |
| 6 | 75.9% |
| 8 | 78.8% |
| 10 | 99.3% |

Sequence alignments and percent identity calculations were performed using the Megalign program of the LASERGENE bioinformatics computing suite (DNASTAR Inc., Madison, Wis.). Multiple alignment of the sequences was performed using the Clustal method of alignment (Higgins and Sharp (1989) CABIOS. 5:151–153) with the default parameters (GAP PENALTY=10, GAP LENGTH PEN ALTY=10). Default parameters for pairwise alignments using the Clustal method were KTUPLE 1, GAP PENALTY=3, WINDOW=5 and DIAGONALS SAVED=5. For large protein sequences the Clustal W program (Thompson et al. (1994) Nuc Acids Res 22:4673–4680) was used. Default parameters were used (GAP PENALTY=10, GAP LENGTH PENALTY=0.2, DELAY DIVERGENT SEQ (%)=30, DNA TRANSITION WEIGHT=0.50, PROTEIN WEIGHT MATRIX: Gonnet Series, DNA WEIGHT MATRIX:IUB). Pairwise alignment also used default parameters (GAP PENALTY=10, GAP LENGTH PENALTY=0.10, PROTEIN WEIGHT MATRIX: Gonnet 250, DNA WEIGHT MATRIX:IUB). Sequence alignments and BLAST scores and probabilities indicate that the nucleic acid fragments comprising the instant cDNA clones encode a substantial portion of a ryanodine receptor protein.

FIG. 1 shows an alignment using Clustal W of the tobacco budworm, green peach aphid, cotton melon aphid, and corn plant hopper (SEQ ID NOs:2, 128, 130, 144, 146, 4, 6, and 8) to a fruitfly (*Drosophila melanogaster*) sequence generated by the methods disclosed herein (SEQ ID NO:10), the *Drosophila* art sequence ((NCBI General Identifier No. gi 17352471, SEQ ID NO:56), an unannotated sequence from the mosquito (*Anopheles gambiae*) genome sequencing project encoding a partial ryanodine receptor (gi 21301556, SEQ ID NO:57), the ryanodine receptor from nematodes (*Caenorhabditis elegans*, gi 1871447, SEQ ID NO:58), sea urchin (*Hemicentrotus pulcherrimus*, gi 18656155, SEQ ID NO:59), mouse (*Mus musculus*, gi 13569850, SEQ ID NO:60), rabbit (*Oryctolagus cuniculus*, gi 1245376, SEQ ID NO:61), and human (*Homo sapiens*, gi 4506757, SEQ ID NO:62). Insect specific sequences can be identified by finding homologous subsequences that are conserved between all of the insect sequences but not amoung the non-insect sequences. A number of these sequences can be found in SEQ ID NOs:63–119.

Prior to the characterization of the sequences presented herein insect specific sequences could not be identified since the fruitfly sequence was the only insect sequence available and this had very low (less than 50%) homology to the other known animal ryanodine receptor sequences.

Table 5 shows the percent identity for the pairwise comparison of the ryanodine receptor sequences shown in FIG. 1. The SEQ ID NOs for the sequences and their respective percent identities are shown.

Example 5

Transient Expression of Ryanodine Recombinant Constructs in Insect Cell Lines The cDNAs encoding ryanodine receptors from different insects were cloned into pIBV5His or pFASTBac as described in Example 2, respectively. However, one skilled in the art would realize that there are numerous other vectors and means of infecting eukaryotic cells. In particular, baculovirus based systems for insect cell infection would be useful, as would any system allowing for the complete expression and modification of receptor proteins in its active form.

The *Spodoptera frugiperda* cell line Sf9 used for transfection studies, was maintained in Sf-900 II SFM medium (Invitrogen Life Technologies™, Carlsbad, Calif.) in T-75 flasks incubated at 27° C. It is understood that those skilled in the art might choose alternative cell types such as the *Spodoptera frugiperda* cell line Sf21 or the *Drosophila* cell line S2. For the purpose of general handling and propagation, cells were suspended through scraping or agitation and a volume of cell suspension was added to each well of a poly-L-lysine coated 96-well, glass-bottom plate so as to provide 70–80% confluence. Cells were maintained in an incubator at 27° C. until testing.

Sf-9 cells were grown at 27 degrees C. in a Corning 125 ml polycarbonate Erlenmeyer flask to a density of 3.1 million cells per ml in SF900-II serum free media (Gibco cat. #10902-088, Invitrogen Life Technologies™, Carlsbad, Calif.). One million cells were transferred to one well of a Corning 6-well, flat bottom cell culture dish (Corning 3516). SF900-II media was used to bring the final volume in the dish to 2 ml and the cells were incubated at 27 degrees C. for 21 h. Following the incubation the media was aspirated from the dish and replaced with 1 ml of SF900-II media pre-warmed to 27 degrees C.

The transient transfection was carried out following an InsectSelect BSD System manual (Invitrogen Life Technologies™, Carlsbad, Calif.). Cellfectin reagent (Invitrogen Life Technologies™, Carlsbad, Calif., catalog no. 10362-010) and SF900-II serum free media (Gibco cat. #10902-088, Invitrogen Life Technologies™, Carlsbad, Calif.) were used in all transfection. The transfection was accomplished by adding the transfection solution drop-wise to the dish and

TABLE 5

Percent Identity For Pairwise Comparison Of Ryanodine Receptor Sequences Shown In FIG. 1

| SEQ ID NOs: | 128 | 130 | 144 | 146 | 4 | 6 | 8 | 10 | 56 | 57 | 58 | 59 | 60 | 61 | 62 |
|---|---|---|---|---|---|---|---|---|---|---|---|---|---|---|---|
| 2   | 99.0 | 98.9 | 98.8 | 98.9 | 76.8 | 77.5 | 79.6 | 78.2 | 78.5 | 79.0 | 45.7 | 46.1 | 47.1 | 47.2 | 47.2 |
| 128 | ***  | 99.8 | 99.6 | 99.6 | 77.6 | 78.0 | 80.3 | 78.8 | 79.2 | 79.6 | 46.1 | 46.5 | 47.7 | 47.6 | 47.6 |
| 130 |      | ***  | 99.6 | 99.6 | 77.7 | 78.1 | 80.3 | 78.9 | 79.3 | 79.8 | 46.4 | 46.5 | 47.7 | 47.7 | 47.6 |
| 144 |      |      | ***  | 99.6 | 77.4 | 78.1 | 80.1 | 78.7 | 79.0 | 79.6 | 45.9 | 46.4 | 47.5 | 47.6 | 47.5 |
| 146 |      |      |      | ***  | 77.9 | 78.3 | 80.8 | 79.0 | 79.3 | 79.8 | 46.0 | 47.0 | 47.5 | 47.6 | 47.6 |
| 4   |      |      |      |      | ***  | 97.9 | 81.9 | 75.4 | 75.7 | 76.5 | 45.6 | 47.3 | 47.0 | 46.9 | 46.9 |
| 6   |      |      |      |      |      | ***  | 82.2 | 75.8 | 75.9 | 76.8 | 45.8 | 47.6 | 47.1 | 47.3 | 47.4 |
| 8   |      |      |      |      |      |      | ***  | 78.4 | 78.8 | 80.2 | 45.9 | 46.8 | 47.2 | 47.3 | 47.2 |
| 10  |      |      |      |      |      |      |      | ***  | 99.3 | 82.3 | 45.3 | 45.8 | 46.6 | 46.8 | 46.7 |
| 56  |      |      |      |      |      |      |      |      | ***  | 82.5 | 45.7 | 45.8 | 46.8 | 46.9 | 46.9 |
| 57  |      |      |      |      |      |      |      |      |      | ***  | 45.8 | 46.8 | 46.7 | 46.7 | 46.7 |
| 58  |      |      |      |      |      |      |      |      |      |      | ***  | 41.5 | 41.0 | 41.1 | 41.2 |
| 59  |      |      |      |      |      |      |      |      |      |      |      | ***  | 48.2 | 48.3 | 48.2 |
| 60  |      |      |      |      |      |      |      |      |      |      |      |      | ***  | 97.1 | 97.2 |
| 61  |      |      |      |      |      |      |      |      |      |      |      |      |      | ***  | 98.6 | incubating 4 h at room temperature with gentle rocking. After the 4 h incubation the media was replaced with 2 ml of SF900-II media pre-warmed to 27 degrees C. and the cells were incubated 2–3 days at 27 degrees C. before testing.

Example 6

Expression of Chimeric Constructs in Microbial Cells

The cDNAs encoding the instant polypeptides can be inserted into the T7 E. coli expression vector pBT430. This vector is a derivative of pET-3a (Rosenberg et al. (1987) Gene 56:125–135) which employs the bacteriophage T7 RNA polymerase/T7 promoter system. Plasmid pBT430 was constructed by first destroying the EcoR I and Hind III sites in pET-3a at their original positions. An oligonucleotide adaptor containing EcoR I and Hind III sites was inserted at the BamH I site of pET-3a. This created pET-3aM with additional unique cloning sites for insertion of genes into the expression vector. Then, the Nde I site at the position of translation initiation was converted to an Nco I site using oligonucleotide-directed mutagenesis. The DNA sequence of pET-3aM in this region, 5'-CATATGG, was converted to 5'-CCCATGG in pBT430.

Plasmid DNA containing a cDNA may be appropriately digested to release a nucleic acid fragment encoding the entire protein or a suitable subfragment or subdomain. This cDNA fragment may then be purified on a 1% NuSieve GTG™ low melting agarose gel (FMC, Philadelphia, Pa.). Buffer and agarose contain 10 µg/mL ethidium bromide for visualization of the DNA fragment. The fragment can then be purified from the agarose gel by digestion with GELase™ (Epicentre Technologies) according to the manufacturer's instructions, ethanol precipitated, dried and resuspended in 20 µL of water. Appropriate oligonucleotide adapters may be ligated to the fragment using T4 DNA ligase (New England Biolabs, Beverly, Mass.). The fragment containing the ligated adapters can be purified from the excess adapters using low melting agarose as described above. The vector pBT430 is digested, dephosphorylated with alkaline phosphatase (NEB) and deproteinized with phenol/chloroform as described above. The prepared vector pBT430 and fragment can then be ligated at 16° C. for 15 hours followed by transformation into DH5 electrocompetent cells (Invitrogen Life Technologies™, Carlsbad, Calif.). Transformants can be selected on agar plates containing LB media and 100 µg/mL ampicillin. Transformants containing the gene encoding the instant polypeptides are then screened for the correct orientation with respect to the T7 promoter by restriction enzyme analysis.

For high level expression, a plasmid clone with the cDNA insert in the correct orientation relative to the T7 promoter can be transformed into E. coli strain BL21(DE3) (Studier et al. (1986) J. Mol. Biol. 189:113–130). Cultures are grown in LB medium containing ampicillin (100 mg/L) at 25° C. At an optical density at 600 nm of approximately 1, IPTG (isopropylthio-β-galactoside, the inducer) can be added to a final concentration of 0.4 mM and incubation can be continued for 3 h at 25° C. Cells are then harvested by centrifugation and re-suspended in 50 PL of 50 mM Tris-HCl at pH 8.0 containing 0.1 mM DTT and 0.2 mM phenyl methylsulfonyl fluoride. A small amount of 1 mm glass beads can be added and the mixture sonicated 3 times for about 5 seconds each time with a microprobe sonicator. The mixture is centrifuged and the protein concentration of the supernatant determined. One µg of protein from the soluble fraction of the culture can be separated by SDS-polyacrylamide gel electrophoresis. Gels can be observed for protein bands migrating at the expected molecular weight. Clearly those skilled in the art might choose other bacterial expression vectors, particularly those that offer a variety of choices of sequences that when fused in-frame with the cDNA insert provide a polypeptide extension that can aid purification like a His tag, MBP or GST extension at either the N- or C-termini of the recombinant protein.

The cDNA inserts can also be expressed in yeast cells. The ryanodine receptor polypeptides can be evaluated by expression of the encoded polypeptides in a yeast (Saccharomyces cerivisae) strain YPH (Stratagene) and assaying the membrane components for ryanodine-sensitive calcium transport. Plasmid DNA (200 ng) from any of the cDNA clones can be used as a template for PCR using primers set forth in the present invention. Amplification is performed using the GC melt kit (Clontech) with a 1 M final concentration of GC melt reagent. Amplification took place in a Perkin Elmer 9700 thermocycler for 30 cycles as follows: 94° C. for 30 seconds, 60° C. for 30 seconds, and 72° C. for 2 minutes. The amplified insert is then incubated with a modified pRS315 plasmid (NCBI General Identifier No. 984798; Sikorski, R. S. and Hieter, P. (1989) Genetics 122:19–27) that had been digested with appropriate restriction enzymes. Plasmid pRS315 had been previously modified by the insertion of a bidirectional gal 1/10 promoter between the Xho I and Hind III sites. The plasmid is then transformed into the YPH yeast strain using standard procedures where the insert recombines through gap repair to form the desired transformed yeast strain (Hua, S. B. et al. (1997) Plasmid 38:91–96.).

Yeast cells are prepared according to a modification of the methods of Pompon et al. (Pompon, D. et al. (1996) Meth. Enz. 272:51–64). Briefly, a yeast colony is grown overnight (to saturation) in SG (-Leucine) medium at 30° C. with good aeration. A 1:50 dilution of this culture is made into 500 mL of YPGE medium with adenine supplementation and allowed to grow at 30° C. with good aeration to an $OD_{600}$ of 1.6 (24–30 h). Fifty mL of 20% galactose is added, and the culture is allowed to grow overnight at 30° C. The cells are recovered by centrifugation at 5,500 rpm for five minutes in a Sorvall GS-3 rotor. The cell pellet is resuspended in 500 mL of 0.1 M potassium phosphate buffer (pH 7.0) and then allowed to grow at 30° C. for another 24 hours.

The cells are recovered by centrifugation as described above and the presence of ryanodine receptor activity is determined using any of the assays outlined in Examples 9, 10, or 11.

Example 7

Expression of Heliothis virescens Ryr cDNA in Insect Cells

The Heliothis virescens, and other, Ryr cDNAs appears to be quite toxic to *Escherichia coli* when placed into a vector under the control of an insect expression vector (e.g. pIB/V5-His, Invitrogen Life Technologies™, Carlsbad Calif.). Under these conditions, the cells grow very slowly and frameshift mutations are spontaneously introduced. Two cloning strategies that completely eliminate any expression of the Ryr gene in *E. coli* would circumvent the growth problems.

In the first strategy, the Ryr gene is cloned into a modified pXINSECT-DEST39 vector (Invitrogen), placing the Ryr gene under the control of an insect actin promoter. In order to completely eliminate leaky expression of the Ryr gene during growth in *E. coli*, a "stop" fragment was placed just downstream of the His tag in the vector, but upstream of the Ryr gene. This stop fragment contains the strong transcriptional terminator T1T2 from the *E. coli* rrnB gene (Orosz et al (1991) *Eur J Biochem* 201:653–659). Also present within this stop fragment is a stop codon in frame with the initiator ATG of the vector. Flanking the stop fragment are Lox sites in direct orientation, such that in the presence of the Cre enzyme, the entire stop fragment will be excised from the vector (Odell and Russell (1994) Homologous Recomb Gene Silencing Plants; ed, J. Paszkowski; pp 219–270), leaving behind a "footprint" of a single Lox site. The stop vector was designed such that following Cre-mediated excision of the stop fragment, the Ryr gene is in frame with the initiator ATG and there are no stop codons present between the ATG and the Ryr gene. The combination of the ATG, His tag, and attB1 from the vector and the residual Lox footprint and associated linker sequences, adds 53 foreign amino acids to the mature Ryr gene product. Construction of the pHE7 vector is outlined in FIG. 7.

The Invitrogen Gateway Entry™ vector pEntr2B (Invitrogen Life Technologies™, Carlsbad, Calif.) was modified to add a PvuI site in the polylinker. pEntr2B was digested with EcoRI and KpnI. Two oligonucleotides, SEQ ID NO:131 (5'-gatccgcggccgcgatcggtacc-3') and SEQ ID: 132 (5'-cgatcgcggccgcg-3') were annealed and ligated into the digested vector to produce pEntr2B/PvuI. The HV Ryr gene from pXLHv7 was digested with PacI and PmeI. pENTR2B/PvuI was partially digested with PvuI (there is a second site in pENTR2B/PvuI) and completely digested with EcoRV and the correct fragment was gel-purified. The PacI sticky end of the Ryr fragment is compatible with the PvuI sticky end and the PmeI and EcoRV ends are both blunt. The 15.4 kb Ryr gene fragment from pXLHv7 was then ligated into the pENTR2B/PvuI to create pENTR2B/PvuI/HV7.

The stop fragment was created by annealing 6 oligonucleotides, SEQ ID NO: 133-SEQ ID NO:138 and then PCR amplified using primers SEQ ID NO:139 (5'-cctttttttcagcgcta-3') and SEQ ID NO:140 (5'-gagagagagtt-taaataa-3'). The resulting product was digested with AfeI and DraI to produce blunt ends, and ligated into the unique AfeI site of pXINSECT-DEST39 to produce pDEST39/LOX.

As an alternative to using pDEST39/LOX, the stop fragment from pDEST39/LOX was excised with XbaI and HindIII and cloned into the pIBN5-His-DEST (Invitrogen Life Technologies™, Carlsbad, Calif.) vector cut with XbaI and HindIII to produce pIBDEST/LOX. pIBDEST/LOX and pDEST39/LOX are functionally similar, both having a stop fragment that can be removed by Cre. One difference is the promoter which controls the transcription of the Ryr gene in insect cells is the actin promoter in pDEST39/LOX but the OpIE2 promoter in pIBDEST/LOX. Also, pIBDEST/LOX contains a blasticidin gene to allow stably transfected cells to be selected.

The Heliothis ryanodine receptor cDNA was transferred from pENTR2B/PvuI/HV7 to pDEST39/LOX using Invitrogen's Clonase LR reaction according to the manufacturer's recommendation to produce pHE7. In vitro reaction of pHE7 with Cre (Invitrogen) according to the manufacturer's recommendation correctly excised the stop fragment and left behind the predicted Lox footprint.

Excision of the stop fragment from pHE7, in the target insect cells was accomplished by cotransfecting them with pMLS104 (Siegal and Hartl (1996) Genetics 144:715–726), as a source of Cre, into SF9 cells. As an alternate approach, the Cre-mediated excision of the stop fragment was done by incubating pHE7 with Cre enzyme in vitro. In these cases, the pMLS104 plasmid was not cotransfected with the pHE7 plasmid. The conditions for the Cre reaction were taken from the Creator DNA cloning kit (BD Biosciences™, San Diego, Calif., Clontech Protocol PT3460-1). For each 250 ng of pHE7 plasmid, 100 ng of Cre recombinase (Clontech Laboratories Inc.™, Palo Alto, Calif., catalog no.8480-1) was used in a 15 minute, room temperature reaction. The reaction was performed in a reaction solution that included 1×Cre reaction buffer and 1×BSA supplied with the Cre recombinase as purchased from Clontech™. Following the 15 minute reaction, the enzyme was heat-killed at 70 degrees C. for 5 minutes. With minor variations to account for non-unique restriction sites, four other Hv clones were constructed (pHI2, pHI3, pHI6, pHI7) with the organization of Cre recognition elements described for pHE7, but fused to the OpIE2 promoter in pIBDEST/LOX.

In a second approach, the toxicity of expression of *Heliothis virescens* Ryr in *E coli*, was overcome using a modified insect expression vector such as pIBN5-His (Invitrogen). An intron fragment was amplified with primers (forward primer: SEQ ID NO:147, 5'-cagtaaagcttgagtcatggaaatttagac-3'; reverse primer: SEQ ID NO:148, 5'-tctggatcctggtttggaaaatgggga-3') from *Heliothis virescens* genomic DNA. The purified PCR product was inserted into a pIB vector into the HindIII and BamHI sites. The DNA sequence of the modified vector was confirmed by DNA sequencing and the Ryr gene from pXLHv7 excised and inserted behind the intron (SEQ ID NO:149), to produce vector pIBiHv7.

Transfection Protocol

All reagents, lab ware and techniques were sterile throughout the transfection. Plasmids were isolated using Qiagen™ plasmid midi prep kit (Qiagen™, Valencia, Calif., catalog no. 12143).

SF9 cells were grown at 27 degrees C. in a Corning 125 ml polycarbonate Erlenmeyer flask to a density of 3.1 million cells per ml in SF900-II serum free media (Gibco catalog no. 10902-088, Invitrogen™, Carlsbad, Calif.). One million cells were transferred to one well of a Corning 6-well, flat bottom cell culture dish (Corning Inc., Acton, Mass., catalog no. 3516). SF900-II media was used to bring the final volume in the dish to 2 ml and the cells were incubated at 27 degrees C. for 21 h. Following the incubation the media was aspirated from the dish and replaced with 1 ml of SF900-II media pre-warmed to 27 degrees C.

In the case of the vectors containing the Cre recognition elements, the transfection solution was mixed in a 1.5 ml microfuge tube by combining 5 μg of pHE7 plasmid, 5 μg of pMLS104 Cre plasmid and 0.5 μg of lacZ reporter plasmid, 15 ug of cellfectin reagent (Invitrogen cat. #10362-010) and SF900-II serum free media (Gibco catalog #10902-088, Invitrogen™, Carlsbad, Calif.) in a total volume of 500 μl. The solution was incubated for 1 hour at room temperature just prior to the transfection.

The transfection was accomplished by adding the transfection solution drop-wise to the dish and incubating 4 h at room temperature with gentle rocking. After the 4 h incubation the media was replaced with 2 ml of SF900-II media pre-warmed to 27 degrees C. and the cells were incubated 3 days at 27 degrees C.

Functional expression of the Ryr cDNAs was observed for all clones (pHE7, pHI2, pHI3, pHI6, or pHI7) as described in Example 9. There was no discernable difference between the functional expression observed from pHI7 and pHE7.

As one skilled in the art would appreciate, several excision systems can be used that would be comparable to that described herein. Examples of excision systems would include, but are not limited to, Cre/Lox, Flp/Frt, Clonase™/Att, Gin/Gix, and R/RS (Odell et al. (1990) *Mol Gen Genet* 223:369–378; Lyznik et al. (1993) *Nuc Acids Res* 21:969–975; Invitrogen Life Technologies™; Maeser and Kahmann (1991) *Mol Gen Genet* 230:170–176; and Onouchi et al. (1991) *Nuc Acids Res* 19: 6373–6378; respectively). These would include homologous excision systems based on the introduction of intron sequences from genomic DNA other than the sequence (SEQ ID: . . . ) described in the second strategy.

As one skilled in the art would appreciate, several fragments bounded by excision sites can be used to eliminate or down-regulate expression in *E. coli* equivalent to that described herein. Examples of such fragments would include, but are not limited to, transcriptional terminators, stop codons that are in frame with the Ryr coding sequence, operators that are recognized by transcriptional repressors, translational attenuators, and sequences which interact with antisense or co-suppression constructs.

As one skilled in the art would appreciate, the stop fragment can be inserted at many different locations in the Ryr cDNA equivalent to that described herein. Examples of suitable locations would include, but are not limited to, in the promoter upstream of the gene, in the 5' untranslated leader, within the coding sequence, and in the 3' untranslated region.

Example 8

Expression of Ryr cDNA in Insect Cells

The Ryr cDNA's from *Drosophila melanogaster* (pIB43D, SEQ ID NO: 9), green peach aphid (*Myzus persicae*) (pIB-GPA7-1, SEQ ID NO: 3), cotton melon aphid (*Aphis gossypii*) (pIB-CMA4-3, SEQ ID NO: 5), and corn plant hopper (*Peregrinus maidis*) (pXL-CPH9, SEQ ID NO: 7) are introduced into the Cre-Lox expression system in the same way as for the cDNA's from *Heliothis virescens* described in Example 7. The cDNA's are released from the vector by digestion with PacI and PmeI. In some cases, there is an internal PmeI site in the cDNA and in these cases, a partial PmeI and complete PacI digestion is performed and the fragment corresponding to the full length cDNA is gel-purified. pENTR2B/PvuI is partially digested with PvuI (there is a second site in pEntr2B/PvuI) and completely digested with EcoRV and the correct fragment is gel-purified. The PacI sticky end of the Ryr fragment is compatible with the PvuI sticky end and the PmeI and EcoRV ends are both blunt. The Ryr gene is then ligated into the pENTR2B/PvuI to insert each cDNA into pENTR2B/PvuI.

The cDNA's are transferred from pENTR2B/PvuI into pDEST39/LOX or pIBDEST/LOX with Invitrogen's Clonase LR reaction according to the manufacturer's recommendation. These expression vectors are transfected into SF9 cells either in combination with pMLS104 or following reaction with Cre in vitro using the protocol described in Example 7 and activity of the Ryr is assayed as described in Examples 9–11.

Similarly, any person skilled in the art would be able to excise the Ryr genes from any source, insect or otherwise and ligate into vectors that satisfy the concept of the second approach in that an intron is used to terminate any expression of the toxic gene in the bacterial host, yet be recognized in an insect cell and be excised by the normal RNA processing machinery of the cell. Transfection of cells would be achieved as described in Example 5.

Example 9

Calcium Release Assays

Calcium Imaging and Acquisition Protocols Using Primary Insect Cells:

Embryonic neuronal cultures of the American cockroach *Periplaneta americana* were established, with minor modifications, following the method of Beadle and Lees (1988) (in Cell Culture Approaches to Invertebrate Neuroscience, Academic Press, New York, pp 123–127). Briefly, 26–27-day old oothecae were collected, surface-sterilized and cut open along a line one-third of the distance below the dorsal midline. The heads were removed and placed in Schneider's *Drosophila* medium (Invitrogen Life Technologies™, Carlsbad, Calif.). Using fine forceps 40 brains were individually removed and placed in a small glass vial containing 700 µl of '5+4' medium ('5+4' medium contained 5 parts Schneider's *Drosophila* medium plus 4 parts roach Basal Medium Eagle, with Earle's salts (BME, Sigma™, St. Louis, Mo.). Roach BME (with Earle's salts) contained 5 parts Hepes (1 M), 1 part penicillin/streptomycin and 44 parts BME (with Earle's salts). '5+4' medium was made fresh and sterile filtered (0.2 µm filter) just prior to use). The brains were dissociated by sequential trituration as follows: 1) brains were passed through a standard Pasteur pipette 10 times; 2) the resulting tissue suspension was passed an additional 5 times through a Pasteur pipet with tip flamed to about half of its original diameter; 3) a final 5 passes were performed using a Pasteur pipet with tip flamed to slightly less than half of its original diameter. A repeat pipettor was used to dispense a 5 µl volume of the resulting suspension into the center of each well of a 96-well, glass-bottom plate previously coated with poly-L-lysine (0.2 mg/ml solution). Cells attached to the bottom of the wells during a 50 min incubation at 27–29° C. 150 µl of a 1:1 mixture of Leibovitz's L-15 medium and Yunker's modified Grace's medium was added, and plates were maintained in a humid incubator at 27–29° C. until use. After cells were allowed to attach wells were filled with a 1:1 mixture of Leibovitz's L-15 medium and Yunker's modified Grace's medium (Leibovitz's L-15 and Grace's medium were obtained from Invitrogen Life Technologies™, Carlsbad, Calif. and Yunker's modified Grace's medium was made with Grace's medium modified by addition of 5 mg L-methionine, 10 mg L-alanine, 182 mg $MgCl_2 6H_2O$, 1 g Albumin Fraction V, 7 ml Fetal bovine serum, 10 ml Chick embryo extract, 2 ml Penicillin/Streptomycin, and 2 mg 20-hydroxyecdysone (prepared in ethanol prior to addition) to a final volume of 100 ml and sterile filtered (0.2 µm filter)). Cells were maintained in a high humidity incubator at 29° C. until testing.

The calcium imaging and acquisition protocols using roach neuronal cells is as follows:

Cells were rinsed in standard physiological saline having the following composition (mM): NaCl 190; $CaCl_2$ 9; KCl 3.1; probenicid 1; Tris buffer 10; pH 7.2. Cells were then bathed in standard physiological saline containing the calcium sensitive fluoroprobe Fluo-4 AM (2 µM) and Pluronic F127 (0.002%) for 45 min. Cells were then rinsed in standard physiological saline for at least 15 min prior to testing. Within the hour prior to testing, standard physiological saline was replaced with standard physiological saline containing the organic cation channel blocker pimozide (10 µM), to inhibit influx of external calcium through voltage-gated calcium channels. The 96-well plate was placed on a Priorm motorized stage mounted onto a Nikon Diaphot microscope and imaged using a 20×Fluor objective (NA 0.75). Individual wells from the 96-well plate were sequentially excited with light at 495 nm, and the emitted fluorescence at 530 nm was detected using a Hamamatsu ORCA ER digital camera with 2 pixel binning (image size 672×512 pixels).

Acquisition control, image processing and image analysis were conducted using Universal Imaging Corporation's MetaMorph™ imaging software (Universal Imaging, West Chester, Pa.). A series of 3 "control" images were acquired for each well. Experimental compounds were added followed by acquisition of 4 "experimental" images for each well. Finally, a positive control compound (a GN analog from Group 2 in Table 7) was added and 2 "standard" images acquired for each well. Experimental and positive control compounds were added via a multi-channel pipettor, although an automated fluidic system could be also be used.

After completion of image acquisition for single or multiple test plates, post-acquisition image processing was performed on the stack of 9 images from each individual well consisting of the following operations: (1) A "classification" image was generated which consisted of a composite of the maximum gray value for each pixel in the image stack. This "classification" image was then used for cell identification. (2) In order to differentiate cell fluorescence from that of background or cellular debris a threshold was set inclusive of pixels having values between 1100–4090 (12-bit image, maximum value of 4095). (3) Individual cells were identified based on meeting the following morphometric criteria: (a) Cell perimeter having a total area between 98–750 pixels, (b) Cell shape being elliptical or round in nature, measured as the ratio of length to breadth (1.0–2.5), and (c) Cells being devoid of "holes" in the region of interest (pixels with gray values excluded by the threshold in the second operation described above). Such parameters had been experimentally optimized for this cell type.

From the above "classification" image regions of interest (ROIs) were generated along the periphery of each identified cell and the mean pixel value for each ROI measured. This measurement was repeated for each image in the stack. Similar calculations were conducted across each well on the 96-well plate and all data recorded in a spreadsheet program such as Microsoft Excel™. Compound-stimulated release of internal calcium stores resulted in a rise in free intracellular $[Ca^{2+}]$ which thereby caused the fluorescence emission of Fluo4 to increase. Alternatively, Fluo-3 AM, Fura-2 AM or other calcium-sensitive fluoroprobes could also be used.

Calcium Imaging and Acquisition Protocols Using Recombinant Insect Cell Lines:

Several drops of a suspension of recombinant *Spodoptera frugiperda* cell line, Sf9, transiently expressing insect ryanodine receptors were placed on a poly-L-lysine-coated coverslip and allowed to attach. Cells were then rinsed in physiological saline having the following composition (mM): NaCl 130; KCl 5.4; $MgCl_2$ 1.2; $CaCl_2$ 1.0; $NaHCO_3$ 4.2; $NaH_2PO_4$ 7.3; Glucose 10; Sucrose 63; MES 20; pH 6.3. Cells were then bathed in physiological saline containing the calcium sensitive fluoroprobe, Fura-2 AM (2 μM), and Pluronic F127 (0.002%) for 30 min. Cells were rinsed in standard physiololgical saline for at least 15 min prior to testing. Testing was conducted in standard physiological saline, as the cell lines are devoid of functional voltage-gated calcium channels.

Imaging studies were conducted using a Nikon Diaphot microscope with a 40× oil immersion objective (NA 1.3) Image acquisition and processing was performed using the MetaFluor™ imaging system from Universal Imaging Corporation (West Chester, Pa.) Calcium calibration was carried out using the Grynkiewicz equation with a dissociation constant $(K_d)$ of 145 nM for Fura-2 (Grynkiewicz et al., 1985). Cell-attached coverslips were placed in a sealed chamber with physiological saline continuously perfused across the cells using a peristaltic pump. Test compounds solubilized in physiological saline were applied by switching the perfusate source.

For studies involving the stable recombinant *Spodoptera frugiperda* cell line, Sf9, (other cell lines could also be used such as Sf21, S2, etc) expressing an insect ryanodine receptor from *Drosophila melanogaster*, or *Heliothis virescens* (alternatively receptors from other species such as *Myzus persicae, Peregnnus maidis, Aphis gossypii*, etc) were grown in T75 (or other appropriate sized) flasks in supplemented Grace's insect medium. Cells were maintained in an incubator at 22° C. until testing. Cells were suspension-loaded with the calcium sensitive fluoroprobe, Fura-2 AM (1–2 μM) and Pluronic F127 (0.002%) in culture medium for 30 minutes under agitation. Cells were then centrifuged and the pellet resuspended in physiological saline having the following composition (mM): NaCl 130; KCl 5.4; $MgCl_2$ 1.2; $CaCl_2$ 1.0; $NaHCO_3$ 4.2; $NaH_2PO_4$ 7.3; Glucose 10; Sucrose 63; MES 20; pH 6.3 at approximately 150,000–200,000 cells per well (96-well plate). After a 30 minute equilibration period the cell plate was tested using a Molecular Devices' FlexStation™ system with dual wavelength excitation (340 and 380 nm) and fluorescence emission measured at 510 nm. Test and control samples were added using integrated fluidics and the intracellular calcium monitored over a 2 minute period.

Using the above protocols FIG. 3 demonstrates the responses to the ryanodine receptor agonist, caffeine (10 mM) and Cpd 16 (10 and 100 nM) on a recombinant Sf9 cell transiently expressing *Drosophila melanogaster* ryanodine receptors (FIG. 3). Similarly, recombinant *Heliothis virescens* ryanodine receptors transiently expressed in Sf9 cells exhibited an increase in cytosolic $[Ca^{2+}]$ following challenges with caffeine (10 mM) and Cpd 5 (3 μM) as shown in FIG. 4. Cells transfected with lipid only (- DNA) or non-transfected cells do not exhibit significant response to caffeine (10 mM) or anthranilamide chemistry. As observed with transiently expressing cells, caffeine and anthranilamide chemistry induce calcium mobilization in stably transfected Sf9 cells expressing recombinant *Heliothis virescens* ryanodine receptor, as shown in FIG. 5. Furthermore, in FIG. 6 it is shown that while wild-type Sf9 cells are insensitive to caffeine, stably transfected Sf9 cells expressing recombinant *Drosophila melanogaster* ryanodine receptor exhibit a dose dependent calcium mobilization.

Alternatively, excitation and fluorescence emission acquisition and liquid handling can be obtained using a whole plate-based imaging reader such as Molecular Device's FLIPR™ system.

Using the above protocols a number of known ryanodine receptor agents from the published literature have been evaluated against native cockroach ryanodine receptors (in embryonic neuronal cells) and transiently or stably expressed recombinant *Drosophila melanogaster* receptors (expressed in Sf9 cells) with results shown in Table 6.

TABLE 6

Known Ryanodine Receptor Agent Activity On
Endogenous and Expressed Insect Ryanodine Receptors

| Chemical Family | Example molecule | Chemical structure | Assay Results | | |
|---|---|---|---|---|---|
| | | | Radioligand Displacement (*P. americana*) | Calcium Release (*P. americana*) | Calcium Releas (*D. melanogaster*) |
| Ryanoids | Ryanodine | 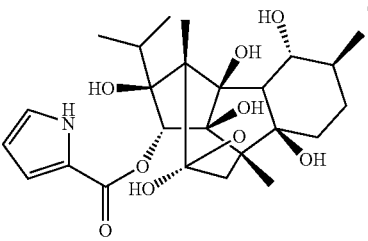 | Inactive | Antagonist | Antagonist |
| Xanthines | Caffeine | 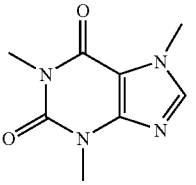 | Inactive | Agonist | Agonist |
| Eudostomins | Bromoeudistomin D | 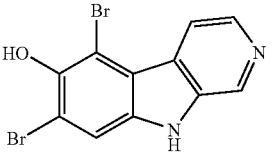 | Not tested | Agonist | Not tested |
| Antraquinones | Doxorubicin | 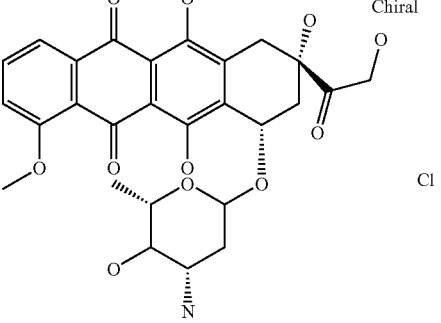 | Not tested | Inactive | Inactive |
| Polycationic reagents | Ruthenium Red | 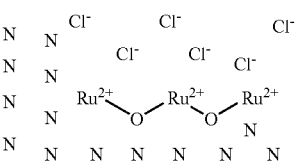 | Displacer | Inactive | Antagonist |

TABLE 7

Data For Selected Anthranilamide Analogs (as shown in FIG. 2)
Tested in Radioligand Displacement and Calcium Release Assays

| | | | | | | Assay Type | | |
| --- | --- | --- | --- | --- | --- | --- | --- | --- |
| | | | | | | Displacement $IC_{50}$ (nM) | Calcium Release Threshold (nM) | |
| Molecule | R1 | R2 | R3 | R4 | R5 | P. americana | P. americana | D. melanogaster |
| | | | | Group 1 | | | | |
| Cpd 1 | isopropyl | H | CH3 | CF3 | F | <300 | <1000 | <300 |
| Cpd 2 | isopropyl | H | CH3 | CF3 | Cl | <300 | <300 | <300 |
| Cpd 3 | isobutyl | Br | CH3 | CF3 | Cl | <300 | Not tested | Not tested |
| Cpd 4 | isopropyl | Br | CH3 | CF3 | F | Not tested | Not tested | Not tested |
| | | | | Group 2 | | | | |
| Cpd 5 | isopropyl | H | CH3 | CF3 | F | <300 | <300 | <300 |
| Cpd 6 | CH3 | H | CH3 | CF3 | Cl | <300 | <300 | Not tested |
| Cpd 7 | isopropyl | H | CH3 | Br | Cl | <300 | <300 | Not tested |
| Cpd 8 | isopropyl | H | CH3 | Cl | Cl | <300 | <300 | Not tested |
| Cpd 9 | isopropyl | Br | CH3 | CF3 | Cl | <300 | <300 | Not tested |
| Cpd 10 | isopropyl | Cl | CH3 | CF3 | Cl | <300 | <300 | Not tested |
| Cpd 11 | CH3 | Cl | CH3 | CF3 | Cl | <300 | <300 | <300 |
| Cpd 12 | isopropyl | Br | CH3 | Br | Cl | <300 | <300 | Not tested |
| Cpd 13 | isopropyl | Cl | CH3 | Br | Cl | <300 | Not tested | Not tested |
| Cpd 14 | CH3 | Cl | CH3 | Br | Cl | <300 | <300 | <300 |
| Cpd 15 | CH3 | Br | CH3 | CF3 | Cl | <300 | <300 | Not tested |
| Cpd 16 | isopropyl | Cl | CH3 | Cl | Cl | <300 | <300 | <300 |
| Cpd 17 | CH3 | Cl | CH3 | Cl | Cl | <300 | <300 | Not tested |
| Cpd 18 | CH2CH3 | Br | Br | CF3 | Cl | <300 | Not tested | Not tested |
| | | | | Group 3 | | | | |
| Cpd 19 | isopropyl | H | Cl | CF3 | CH3 | <3000 | <10000 | <10000 |
| Cpd 20 | isobutyl | H | Cl | CF3 | CH3 | Not tested | Not tested | <3000 |
| Cpd 21 | isopropyl | H | CH3 | CF3 | CH3 | Not tested | Not tested | <3000 |

Example 10

Roach Muscle Membrane Preparation

The procedure for preparation of membranes from cockroach femoral muscle for radioligand binding studies was essentially as described by Schmitt, et.al. (1996) *Pesticide Science* 48:375–385. A brief description of the steps involved is as follows:

Mid and hind legs from 6–9 week old cockroaches were excised and immediately placed in liquid nitrogen. Excised legs could be stored at −80° C. for several months, if necessary, prior to further fractionation. Typically, membrane preparations started with approximately 55 g (wet weight) of excised legs. All subsequent steps were carried out at 4° C.

50 mM Tris-HCL, pH 7.4 was added at a ratio of 9 ml buffer to 1 g (wet weight) of legs. The legs were homogenized on ice using a Polytron (Brinkmann Instruments, Westbury, N.Y.) for 2 min at Setting #3. In order to remove all fragments of cuticle, the homogenate was first passed through two layers of cheesecloth and then through one layer of glass wool overlaid on two layers of cheesecloth. On occasion, the cheesecloth clogged with particulates prior to passing all material through. In such cases, fresh cheesecloth (and glass wool) was used for the remainder of the suspension. The filtrate was collected in 50 ml centrifuge tubes and centrifuged in a Sorvall SS-34 rotor at $1,950 \times g_{max}$ for 20 min. The supernatant was collected and centrifuged for 30 min at $30,000 \times g_{max}$. The resulting pellet was resuspended in buffer A (1.5 M KCl, 0.3 M sucrose, 0.5 mM $CaCl_2$, 20 mM Tris-HCl, pH 8.0). The membrane suspension was homogenized by hand (about 25 strokes) using a glass-teflon homogenizer. Protein concentration of the suspension was determined by the method of Lowry, et. al. (1951) *J. Biol. Chem.* 193:265–275. Subsequently, the membrane suspension was adjusted to 4 μg protein/μl by addition of buffer A and then stored in 1 ml aliquots at −80° C.

Example 11

Radio-ligand Binding Assays

Ryanodine used were obtained from Sigma (St. Louis, Mo.).

The structures for the following compounds are shown in FIG. 2 and Table 7.

1-(3-Chloro-2-pyridinyl)-N-[2-methyl-6-[[(1-methylethyl) amino]carbonyl]phenyl]-3-(trifluoromethyl)-1H-pyrazole-5-carboxamide (Cpd 5) was prepared at DuPont (Wilmington, Del.).

N-[4-Bromo-2-methyl-6-[[(1-methylethyl)amino]carbonyl]phenyl]-1-(2-fluorophenyl)-3-(trifluoromethyl)-1H-pyrazole-5-carboxamide (Cpd 4) was prepared at DuPont (Wilmington, Del.).

[$^3$H]-Ryanodine (Ryanodine [9,21-$^3$H(N)]) was obtained from PerkinElmerrm™ Life Sciences (Boston, Mass.). 1-(2-

Fluorophenyl)-N-[2-methyl-4-tritio-6-[[(1-methylethyl)amino]carbonyl]phenyl]-3-(trifluoromethyl)-1H-pyrazole-5-carboxamide (Cpd 1) was prepared at 21 Ci/mmol from N-[4-Bromo-2-methyl-6-[[(1-methylethyl)amino]carbonyl]phenyl]-1-(2-fluorophenyl)-3-(trifluoromethyl)-1H-pyrazole-5-carboxamide (Cpd 4) by PerkinElmer™ Life Sciences (Boston, Mass.).

[$^3$H]-GN Analog [Cpd 1] Binding to Roach Femoral Muscle Membranes:

For saturation binding assays, the assay mixture (200 µl total volume/well; 96-well, U-bottom, polypropylene plates) contained 163 µl of buffer B (0.375 M KCL, 0.3 M Sucrose, 0.0005 M $CaCl_2$, 0.020 M Tris-HCl, pH 8.0), 10 µl of various concentrations of Cpd 1 in DMSO, and 2 µl of DMSO. For determination of 'Non-Specific' binding, the DMSO was replaced by 2 µl of a combined solution (in DMSO) of 0.001 M ryanodine plus Cpd 5 at a concentration 1,000-fold excess that of Cpd 1 in the corresponding 'Total' binding tube. The assay was begun by addition of 25 µl of roach muscle membranes at 2 µg/µl (prepared by thawing and addition of an equal volume of buffer B), and incubation was carried out for 60 min at 32° C. Assays were carried out in triplicate.

Displacement of Cpd 1 by selected compounds was as follows: to each well containing 163 µl of buffer B, 2 µl of 0.001 M ryanodine (in DMSO) and 25 µl of roach muscle membranes (at 2 µg/µl prepared as described above), was added 2 µl of various concentrations of the selected compound in DMSO. The compound was allowed to pre-incubate with the membranes for 10 min at 32° C. Following pre-incubation, 8 µl of 625 nM Cpd 1 in DMSO was added and incubation was allowed to proceed for 60 min at 32° C. Assays were carried out in triplicate.

Following incubation, assays were quenched with ice-cold buffer B and immediately filtered on pre-wetted Unifilter 96 GF/B filter microplates using a Unifilter 96 Harvester (PerkinElmer™, Boston, Mass.). Each assay well was then washed 10 times with buffer B, and collected on the same filter microplate. The filter microplates were then placed in a vacuum oven at 32° C. for 3 h, following which 50 µl of Microscint 0 (PerkinElmer™, Boston, Mass.) was added to each well. Plates were then heat sealed and counted using a Topcount microplate scintillation counter (PerkinElmer™, Boston, Mass.).

[$^3$H]-Ryanodine Binding to Roach Femoral Muscle Membranes:

For saturation binding assays, the assay mixture (200 pi total volume/well; 96-well, U-bottom, polypropylene plates) contained 155 µl of buffer A (1.5 M KCL, 0.3 M Sucrose, 0.0005 M $CaCl_2$, 0.020 M Tris-HCl, pH 8.0), 10 µl of various concentrations of [$^3$H]-ryanodine in ethanol, and 10 µl of DMSO. For determination of non-specific binding, the DMSO was replaced by 10 µl of ryanodine (in DMSO) at a concentration 1,000-fold excess that of [$^3$H]-ryanodine in the corresponding Total binding tube. The assay was begun by addition of 25 µl of roach muscle membranes at 2 µg/µl (prepared by thawing and addition of an equal volume of buffer A), and incubation was carried out for 60 min at 32° C. Assays were carried out in triplicate.

Displacement of [$^3$H]-ryanodine by selected compounds was as follows. To each well containing 155 µl of buffer A and 25 µl of roach muscle membranes (at 2 µg/µl prepared as described above), was added 10 µl of various concentrations of the selected compound in DMSO. The compound was allowed to pre-incubate with the membranes for 10 min at 32° C. Following pre-incubation, 10 µl of 200 nM [$^3$H]-ryanodine in ethanol was added and incubation was allowed to proceed for 60 min at 32° C. Assays were carried out in triplicate.

Following incubation, assays were quenched with ice-cold buffer A and immediately filtered on pre-wetted Unifilter 96 GF/B filter microplates using a Unifilter 96 Harvester (PerkinElmer™, Boston, Mass.). Each assay well was then washed 10 times with buffer A, and collected on the same filter microplate. The filter microplates were then placed in a vacuum oven at 32° C. for 3 h, following which 50 µl of Microscint 0 (PerkinElmer™, Boston, Mass.) was added to each well. Plates were then heat sealed and counted using a Topcount microplate scintillation counter (PerkinElmer™, Boston, Mass.)

Example 12

Expression Vector for *Drosophila melanoqaster* Ryanodine Receptor Gene

Based on the published ryanodine receptor gene sequence of *Drosophila melanogaster* (NCBI accession number D17389), two primers were designed (SEQ ID NO:141, 5'-accaccttaattaattccgatttggaggcgctgcg-3'; and SEQ ID NO:142, 5'-gcctccgtttaaacgaccgtccagtgccagtgtgaag-3') These primers were used for long PCR reactions following the condition in Example 1 using a cDNA library from adult *Drosophila melanogaster* (Clontech) as template. The full-length ryanodine receptor genes were cloned into a pCR-XL-TOPO® vector (Invitrogen Life Technologies™, Carlsbad, Calif.) and the full-length genes subsequently subcloned into modified pIBV5His or pFASTBac vectors as described in Example 2.

SEQUENCE LISTING (149 sequences)

SEQ ID NO: 1 - DNA, 15679 bp, Heliothis virescens
  CDS (251)..(15676)
  misc_feature (5515): n = c or g
  misc_feature (13000): n = a or t
ctaaattcgaaattcccatctcgactccgactggaaaggcccctgattgggacaatttgtttatgggacgtgtgattattccgaatttagaatcattagtgttgtgaacggttaaaaatgtgttaacagtgcgtgcagcgttgattccagaaaaaacggatttatttgtgcgttttgacgcatgtgtgatgcatttcgagtgttatggcaacgttgcagtaaggcactgacagtctactgagaatccaagatggcggaagcagaggggggagcaagcgagcaagatgatgtttcaatcttgcgtacggaagacatggtgtgcatgtcgtgcacagcgacaggagagagggtgtgcctggctgccgaaggtctcggcaaccggcactgcttcctggagaatattgccgacaagaacataccgcctgatctgtcgcagtgtgtgtttgtcatcgaacaggcgctttcagtaagagctttacaggagttggtaacagctgcgggatctgaaactgggaaagaaaacttaggtaaaggtaccggttctggttatcgtacgctactatacggcaatgctattcttttgcgacatcttaacagtgatatgtacctggcctgcctgtcaacatcatcatcccaggataagctggcctttgacgtgggtctgcaacagcactcccaaggtgaagcctgctggtggaccctgcatcctgccagcaaacagagatccgagggcgagaaggtgcgagtcggagatgacttgattctagtctccgtggccattgagagatacttgcacacaacgaaagagaacgaagtatcgatagtgaacgcgtcgttccacgtgacgcactggtcggtacagccctatggtactggtatatcgaggatgaagtatgtgggctatgtgttcggaggtgatgtgctcaggttcttccatggaggtgacgagtgtctcactatacctagcacttggacaaaggatggggggcaaaatatcgtagtctacaaaggaggttcagtgatgtctcaagcccgttctctatggcgcctggagctggctagaaccaagtgggccggaggtttcattaactggtaccatcctatgaggattcggcacatcactactggaagatatcttggagttaacgaccagaatgagctgtatttagttagcagagaggaacccacaacagcttcctgtgccttctgcctgcgccaggagaaggatgatcagaagcaagtgttagaagacaaggacttggaggtcataggcgcgcccatcatcaagtacggtgactccaccgtcattgtgcagcattcggagactggcttgtggctgtcttataagtcttacgaaacgaagaagaaaggcgtgggtaaagtagaagagaagcaagcgattctccacgaggaaggcaagatggacgatggcctcgacctctccaggtcacaggaggaagaatctatgactgctcgagttatcaggaagtgttcttcgctgttcactaagtttatcaatggcctggaaactcttcaagagaaccgtcgtcactcgatgttcttcgcgtcagtgaacctgggcgagatggtgatgtgtcttgaagatctcaccaactacttcgcacagcccgatgaggatatggaacacgaagaaaagcaaaacaaattccgcgccctccgcaaccgtcaggacctgttccaagaggaaggcatactgaacctgatcctcgaagctatagacaagatcaacgtcgtcacgtcccaggggttcctggctggattcctggcgggagacgaatctggacagagctgggaaatgatatctggatatttgtatcagttgctggcggcaataataaaaggcaaccacacgaactgcgcgcagttcgcgaactcgaaccggttcaactggctgttctcgcgcctcggctcgcaggcctcgggcgagggcaccggcatgctcgacgtgctgcactgcatcctcatcgactcgcctgaagcgctcaatatgatgagggacgaacacataaaagtgataatctctctattagaaaagcacggacgcgaccctaaagtactagatgtgctatgttcactctgcgtcggtaacggcgtcgcggtgcgctcgtcacagaacaacatctgcgactatttgctgcccggcaagaacctgttgctgcaaactgcgcttgtagatcacgtatctagtgtccgtccgaacatcttcgtgggccgagtagaagggtcggcagtgtaccgcaaatggtacttcgaggtgactatggaccacatagagaagaccacacatatgatgccacatctacgcataggatgggctaacactactggttatgtcccatacccgggtggtggtgagaagtggggaggtaacggcgtgggagacgacctgtactcgtacgggtttgatggcgcctacctctggtccggcgggaggaagaccccggtcaataggactcatgctgaagagccttatattaggaaaggtgacgtgataggttgtgcattggacctgacggtacccatcatcaacttcatgttcaacggagtgcgggtgacgggatccttcaccaacttcaatctggaaggcatgttcttcccggtcatcagctgctctagtaagctgagttgtcggttcctgctgggcggagaacacggtagactccggtacgcggctccagaaggctactccccgctggtggagtctctcctgccgcagcagatcctcagcctggagccgtgcttctacttcggcaacctgtccaagcgggccttggctggacccccgctagtacaggacgatacggcttttgtgcctacgcctgttgatactttacagattactctgcctacatatgtggaacaaatcagagacaagctagctgaaaatattcacgaaatgtgggctatgaataagatcgaagcaggctggatgtacggcgaccagagagaagacttgcacaagatccacccctgcctcgtgcccttcgagcgactcccgcccgctgagaaacgatacgatatacaacttgctgtgcagacactcaagactatcctggctctgggctactacatcagcttagataagcctccagcacgcatccgcaacgttcgtctgcccaatgaacctttcatgcagtccaacggctacaagccagcaccactcgacctgagtgctgtcaccctgacacccaagatggatgagctagtaggccagctggctgagaacacccacaacctttgggccagggagaggatacagcagggatggacttacggacttaatgaggactcggacatgcatcgatccccgcacctggtgccatacccgaaggttgacgatgccatcaagaaggccaacagggacacagcctcggagactgtgaggaccctgctggtctacgggtatatgctggacccgcctactggggagcagcatgaagcactcttgttggaagcgtcaaaacagaagcaagccgacttcagaacataccgcgctgagaagaactatgccgtcagctctgggaagtggtacttcgagtttgagatcctaacggctggacctatgagggtcggctgggctcacgctgatatggcaccaggaatgatgctcggacaagacgagaactcctgggcttttgatggttacaatgaggaaaaagtgtacagcggtaacactgagtctttcggcaagcaatgggctgttggtgacgtagtgggggtgttcctagatctcattgataagacgataagtttctcactcaacggtgagttgttgatggatgctcttggcggagagactacgtttgctgatgtccagggtgacaactttgtacctgcttgcacgcttggtgtcggccaaaaagccaggttaacatacggtcaggacgtgaacacgctgaaatacttcacaacatgtggtctgcaggagggatatgaaccattctgtgtcaatatgaagagagacgtgactcactggtacaccaaagaccagccgatcttcgagaatacggatgagatgatcgacaccagaatagatgtgaccaggataccagctggttcagatacacctccatgcctcaagatttcccacaacacgtttgagacgatggagaaagctaactgggagttcttacgtctctcactgcctgtcatctgccataacgagttcattgacgaggcagaaaaagccaggcgttgggtagaaatcaaggaccgccaacggatcctaatgaaagaggcagttgaagctcagatgtccgcccatattgaccagatcatgaggagcggtttcaccatgaacgatattaaaggtttgcactacgaagacaatcaggaagagttgcccagctccaagatgaagcgcctgccttcaaggccaccacgtaagggatccatgacaagaggtgttactatacaaaattacaataatttgcaaccaggccaagtcaacggcatgcaccggtcgaccagtgaagctgaaatggccaagtatgacttgggagcgcaaggtttgacgcctgatgataagaaggacaagaggggacgatcgcctttcaagttcttcagaagcaagcgcggcgaaagcagtgatcgtgctaaatcccgtaaatccaaaacaccagaccccttcagtgataccgaagtatcaccagaacgtggtgctcgaaggcctaaccctcagatcaaagtgtcacaggccaatcaaagatataacggcatgaacgcgcgtcctagcaggaccaacctgtatgggagccaagttggtttgaactcgaacgctcagatggcgacgcccacgcaagacaggaagcagatgacgaccagcactctcgcgcagtcggctacggaaactgtcggcaatgagatcttcgatgcagagtgtttgaagctcatcaatgagtacttttatggagtcaggatctacccaggtcaagacccaacccacatgtacatcggctgggtgaccacccagtaccacttgcactctaaggacttcaaccagagcaaggtcaccaagtcctctgtcatcatcactgatgattacgatagggttgttgagaacgtaaaccggcaatcgtgctacatggtgcgagctgatgagctgtacaacgaggtgatggcggaagccacggccaagggtgcctcgcaaggcatgttcatcggctgctccgtcgacacctccaccggcagcgtgtccttcacctgtgaggggaaggacaccagcttcaagtttaagatggaaccagaaacaaaattgttccccgcgatctccgtagaagcgacctccaaggagatcctgcagatagagctgggcagatcagccaccagtctgccactatcagccgctgtactacctacgagtgataagcatgtcataccacagttcccgccgaggttgaaggtgcagtgcttgaaaccacatcagtgggctagggtaccgaaccaatcactacaagtccacgctctgaagttgtccggcatccgcggttggtcnatgctgtgtgaagacgccgtttctatgctagctttacatataccggaggaagatcgctgcatagacattttggagctgatagaaatggacaaactcctaagtttccattctcacaccctcacgttatacgctgctttatgttaccagagtaactacagggcggcccacgctctgtgctcgcacgcggaccagaagcagctgctgtacgcgatccagtcgcagtacatgtcgggcccgctgcgccagggcttctacgatctgctcacagcactgcatctcgagtcgcatgccaccaccatggaggcgtgtaagaacgagttcgtgatcccgctgggcccggagctgaaggcgctgtacgaggagcccgacatgggacactcgctgcgctcgctgcagaccgagagcgtgcgcccgcagatgaagatgaccgatatcgctgaaagtataaccgagataagcaacctatactcgccgtacttcccgctggaggtggtgcgcgagttcgtgatgcaggcgctggctgaagccgtggagaccaaccaggtgcacaactgggatcctgtcggggggagcaatgagaacctgttcctgcctctaataaagttggtggaccgtctcctgctggtcggcatgatgcgcgacgaagatgtggagaagctactcatcatgaccaaccctgagacatgggacccctcgtttgacaaagagggtaaagacgagcaccgcaaaggtctactccacatgaaaatggcggaaggcgctaagctgcagatgtgttacttactgcaacatctcaacgacatacagctgcggcacagggtcgaagctaccattgcgtttgcgcatgacttcgtcggtgatctacagactgatcagctcagacgttacacggaaatcaagcagtcggacttgccgagcgcggttgccgctaaaaagacgagggagttccgttgtccgcctagagaacagatgaacgttatactgagtttcaagcacctagaggaagaagacaaggagaactgtccgtgcggcgaggagctgatcgcgcgcatgaacgagttccacgacaccctcatggcgcacgtgtcgctgcacgcgctgcaggagcctgatgctgcggaaaatcaagaacctgaagcaaaaccgggggcattcggcaagctatacaacattatcaatacggtcaaggaattagaagaggaagctaaggcaatagaagagcctccgaagaagacgcctgaggagaagttccgtaaggtcctcatccagaccatagtgaactgggctgaggagtcgcagatagaaacacccaagcttgtcagagaaatgttcagtcttctagtccgccagtacgacgcagtaggcgaactaatccgcgctctagagaagacatacgtcatcaacgcgaagaccaagttagatgtcgccgagatgtgggtggggctcagccagatccgagccctgctgcctgtgcagatgagccaggaggaagaggaactcatgaggaagaggctctggaaacttgtgaacaaccacacgttcttccagcatccagatttaatcagggtgctccgcgtgcacgagaacgtgatggcggtgatgatgaacacgctcggccgccgcgcgcaggcgcagtccgacgcgcagccctcctcacagcctgtcgcggaggataacaaggagaaggacacatcacacgaaatggtggtagcttgctgccgtttcctctgctacttctgccgtaccgggagacagaaccagaaggccatgttcgaccacttcgacttcctcctggagaactccaacatcttgctgtccagaccctcgctgagaggatccacccctctggacgtggcctactccagtcttatggagaacactgaactagcgctggctttgagagagcactacctggagaagatagcagtgtacctgtcccgctgtggtctgcagagcaactcggagctggtggagaaggggtaccctgacctcggctgggatccagtcgagggggagcggtatcttgacttcctgaggttctgcgtttgggtaaatggcgaaagcgtagaagaaaacgcgaacctagtgatccgtctgctgatccgtcgtccagagtgcctcgggccggcgctgcgcggcgagggcgaaggcctgctgaaggccatcgtcgacgccaacaagatgagcgagaggatcgccgacaggaggaagctcagggaaatggagcaggagggagatgttaacttcagccaccccctcccggagtcagatgaggatgaggactacatcgacacgggcgccgccatcttgaacttctactgtacattggtagatctgctcggaagatgtgctcctgatgctggcgttattgctctcggcaagaacgagtctctccgtgcccgcgctatcctgcggtcgctggtgccgctggaggacctgcagggagtgctgagcctgcgcttcacgctcaacaaccctgctgctggagaggaacgacccaagtctgatatgccatcgggtctgatcccgggacacaagcagagcgtgggactgttcctggggagagtgtacggcatcgaaactcaggagttgttctacaaactgctggaggaagccttcctgcctgacctcagggctgccactatgctggacaggaacgacggctgcgaatcagacatggcgctgtcgatgaaccgctacatcggcaactcgatcctgccgctgctgatcaaacacgcttacttctacaacgaagctgagaactacgccagtttattggatgccacgctacatactgtttataggttatcgaagaaccgcatgttaaccaagggtcaacgtgaagcggtgtcagacttcctagtggcgcttacttcagcgatgcagccctctatgttgctcaagctgctcaggaaattgacggtcgacgtgtctaaactgtccgagtatactactgtcgctcttaggctgctgacgctgcactacgagcgctgcgcgaagtactacggcagcacgggcgcggggcagggcgcgttcggcgcgtcgtcggacgaggagaagcgcctcaccatgatgctcttctccagcatcttcgactcgctcagcaagatggactacgagcccgagctcttcgggaaggcgctgccctgtcttattgctataggatgcgctctgcctcctgactacactctctcaaagaactatgatgatgagttttacggcaaagagcaagctgcaggtgacctagacaacccccaatacgaccctcagcccataaacacgtcctcagtagcattgaacaatgatctcaacacgatcgtacagaagttctcggaacattaccacgatgcgtgggctagtaggaagattgagaacggctgggtgtatggggagggctggtctgatagccagaagactcatcctaggctgaagccttataatatgcttaatgattatgaaaaagagcgttacaaggagccagtacgtgaatctctgaaggctcttctagccatcggttggtctgtagaacattcagaagtagacataccgagtaacaaccgaagctccatgggaaggcagtccaagtcgggaggccgccctcccgaaattgtgacagactcggcgactccgttcaactacaaccctcacccagtcgacatgaccaacttgacgctatcgagggagatgcagaacatggcggagaggctcgctgacaacgcacacgacatctgggcgaagaagaagaaggaagaacttgttactaatggaggtggcatccacccccaactagtaccctacgacctcctaacagacaaagaaaagaagaaagatcgagaacgttctcaagagttcctcaaataccttcaataccaagggtacaagctccaccggcccagcaaggcgccacaaagtgatacggaacaaaccactacgggggtagcaatagagttgagattcgcatactcgctcctcgagaaattgatccagtacatcgatagggccaccattaatatgaagcttttgaaaccttccactacgtttagtaggagaagtagttttaagactagtaccagggatattaagttcttttctaaggtggtgctgcctctaatggagaagtatttctcgacgcatcgtaactacttcatagctgtagctacggcgacgaatagtgttggtgcagccagcctgaaggagaaagagatggtagctgctctgttctgtaagctggctagcttgcttagatctagactcgcagctttcggtcctgacgtccgcatcacagtccgctgtctccaagtgttggtgaggggcatcgacgccaagtccttagtgaagaactgccccgagttcatcaggacctccatgttgaccttcttcaacaatgtcgctgatgatgtagggcatacgatcatgaatttgcaggatggtaaatacgcacacctacgaggtacccacttgaagacatccacgtctctcggctatatccacggagtactgctccccatactgacagccaaattcgaccatctggctaactgcgagtacggtgctgatctgttgttggacgagatacaagtggcgtcatacaagatgttgggctccctgtacgcgctcggcacggacgcttcgctcacacacgacagaaagtacctcaagactgagattgagagacataaacctgctttgggttcatgtctaggtgcgttcagttcgacattcccagtagcgttccaggagcctcacttgaacaaacacaaccagttctccttgctgaacaggatcgctgaccattctttggaagcccaagacataatgcagaaaatggaacaatgcatgccgacgttagagacgatcttaggcgaggtggaccaattcgtggagtcagacaagacgtacaacgaagcgccgcatatcatcgatgtggtgttgcctttactctgttcttacttgccgttctggtgggcacaggggcctgataatgtcactcctactggcggaaaccacgtaacaatggtaacagcggaacacatgaaccagctcctcaagaatgttctgaagctcatcaaaaagaacatcggcaatgagaacgcgccgtggatgacccgcatagccacctacacccagcagatcatcatcaacagctccgaggagttgctgagggattccttcctgccgctcgctgaacgtgttcgcaagcgcacggacaatatgttccataaggaggagagcttgagagggtttattaagtcgtcaacagacgacacatctcaagtagagtcacagatacaagaagactggcagctgctggtcagagacatctactccttctacccgctactcatcaagtacgtcgacctgcagaggaaccactggctcaggaacaatgttccagaggcggaagagctgtacaaccacgtggccgaaatcttcaacatatggtcgaagagccagtacttcttgaaggaggaacagaacttcatctctgccaacgagattgataacatggtgctgattatgccaacagcaacaagaagagtgacagcagtaacagatggtactcctcaaggcggtggaaagaaaaagaagaagcaccgtgataagaaacgcgacaaagacaaggaagtccaagcgtccctaatggtagcttgtctgaagaggttgctaccagttggccttaacctattcgctggcagagaacaagaactggtgcagcattgtaaagacaggttcctgaaggtagggaccctcaagaaaatgtcagaacaagatgtggcagaattcgcgaagacccagctgacacttccagataaaatagatccggcagacgaaatgtcttggcaacattacttgtatagcaagttaggttcgaagagtaagagcaatataactgtggaaactgctgaaaataaagccaagattattgatgatactgttgaaaggatcgtcgctatgagtaaagtgcttttcggattgcatatgatcgaccatccccaacaaatgagtaagaacgtgtaccggtcggtggtgtccatacaacgcaagcgcgccgtcatcgcctgcttccgacaaacttcactacattctctgccgagacatcgagcgtgtaacatcttcgctcgcacgtactacgagctctggttggaagaggagaacattagacaagaagtaatgatagaagatcttactcaatcattcgaagacgcagagctgaagaagagtgacgtggtggaggaaggtgagaagcctgaccccctcacgcagctggtcaccacctcctgtcgcggtgccatgactgagaggtccggcgctttgcaggaggatcctctatacatgtcttacgcacacatcatagcgaagtcctgtggagaagaagaggaagaagggggtggggaggaagaggaagggggtggagaagcagaggctgaagacgaaggcagagccagtatacacgaacaagaaatggagaaacaaaagctcctattccaccaagcgcggccggcggaccgtggggttgccgaaatggtgttgctgcacatctccgcgtccaaaggcctgcccagcgagatggtcatgaagactttacagctcggtattagtatactgaggggcggcaatattgatatacagatgggtatgttgaaccacttgaaagacaagaaagacgtgggcttctttacgtccatcgccggcctcatgaactcctgctccgtgctcgatcttgacgccttcgagaggaacaccaaggctgaaggtctgggcgtgggtctggaaggtgcggcgggagagaagaacatgcatgacgccgagttcacctgcgcactcttcaggttcattcagctcacctgtgaaggacacaacttggactggcagaactacctgcgaactcaggccggtaacacgacaacagtgaacgtggtcatctgcaccgtcgactacctgctgcggctgcaggagtccatcatggacttctactggcactactcaagcaaggaactgatcgacccggctggcaaagcgaacttcttcaaggccattggcgtggcttcccaagtattcaacaccctcactgaagtcatacagggaccttgtacgcagaatcagcaggctttggctcactccaggttgtgggacgctgtcggtggtttcctgttcctattctcccacatgcaggacaagttgtcgaagcactcgtcgcaggtggacctgctgaaggaactcctcaatccgcagaaggacatgatcaccatgatgctgtccatgcttgaaggaaatgttgttaatggtacaatcgtcaagcaaatggtggacacactagtaggatcggcctccaacgtggaactgatcctgaaatacttcgacatgttcctcaagctgaaggacctgacctccagcgccagcttccaggagattgatgccaataacgacggctgggtgctgcccaaggacttcaaggagaaaatggaacaacagaagagttatacncccgaagaaatcgagttcctcctagcttgctgcgagacgaaccacgacggcaagttagactacatcggtttctgcgaccgtttccacgagcctgccaaggagatcgggtttaacttggccgtgttactgactaacttgtctgaacatatgccgaacgagcctagattggcacgttttctggagacggcaggttcagtcctggactacttcgaaccattcctgggccgtatcgagatcatgggcggctccaagcgcatcgagcgtgtctacttcgagatcaaggagtctaatatagaacagtgggagaaaccgcaaattaaggaatccaaacgcgcgttcttctacagcatagtaacagaaggtggtgatagagaaaaattggaggctttcgtgaacttctgtgaggacgccatctttgaaatgacgcacgcgtcgggactgatggccgcgtccgaagagtcggtgggagggaccaagaatagagaggccagctatatgtatatgggggatgatggtgatgagagagccggcaaagatccattccgtcgcggactccagtcagtcaaagacggcgtcgccacggcattttcatccttatctccttccaacataaaggcgaaaatcgcagacatgcagcaaatgccaccagccgaactagctgtgggcttcttcaaaatgttcttctatccattctattacttgggctatggagttctcgtcgttgtcaggtatatattcggtgtgctcttgggtctgatgcgaggtcctcagacggatgaaccgcctccggagccgacggaagaggagaaaatcggtcagttgagacacaggttgctagcgacacaaagttctcgacatctcccggcgttgcctccagctgatgatacgggacagatgcaagtgtcggcattcggactcgatatcaccaaagaagacaatggacagatacaagtaaaacctcacgaatcacccagcacatccactccatcatcaggcggggaggcggaggtgtcacccgacgagagcgccgaccacacggaggagcagagaccgccttctcttatcgacctgcttggtggggaacaagctaaaaagcaagctcaggagaggatggaagctcaagctgctcaacaagctgccatgtcggccattgaagctgaaagcaaaaaggcagtgcaagggcccgcaccatcagcgctatctcaagtggacctgtcccagtacacccggcgcgcagtctcgttcctagctcgcaacttctacaacctgaagtacgtggcgctcgtgctggccttctgtatcaacttcgtgctgctcttctataaggtatctaccctggatggtgaaggtggtgaaggttcaggtctgggtgacatcatcgccggtgggggttccggatccggggctggctctggcagtggagacggtagcggcgagacaggggaagatgacgacgcgttagaagtagtacacatagacgaagacttcttctatatggaacacgtcatcaagatggcggccgtgctgcactctatcgtgtctctggctatactcattggatattatcatcttaaggtgccgctagccatcttcaaacgtgagaaggagatcgctcgtaagctggaattcgacgggctgtacatcgctgaacagcctgaagacgacgacctcaagagccactgggacaagctcgttatatctgccaaatcattccccgtaaactactgggacaagtttgtgaagaagaaggttcgcgccaaatactcggagacatatgacttcgactccatctccaacatgttgggcatggagaagacttccttctccgcgcaagaagaagaaggcagcaaaggacttattcattacataatcaacatagactggcgctaccaagtgtggaaggccggcgtgacgatcacagacaactcgttcctctactcgctatggtacttctccttctccgtgatggggaacttcaacaacttcttcttcgcggcacacttgttggacgtggctgttgggtttaagaccctgaggactatcttgcagtctgtcacgcataatggaaaacagctggtattaacggtgatgctgctgactataatcgtgtacatctacacggtgatcgcgttcaacttcttccgcaagttctacgtgcagggggaggacgacgaagtcaataggaactgccatgacatgttgacgtgcttcgtgttcaacttgtacaagggtgtgcgggcgggcggcggcatcggcgacgagctggagccgcctgatggagacgactccgaggtctaccgcatcatcttcgacatctccttcttcttcttcatcatcgttatcctgctcgctatcctgcagggtttgatcatcgacgcgttcggagagctgcgtgaccagttggagtcggtcaaggaggacatggagtccaactgcttcatctgcggcatcaataaagactattttgataaagtgccgcacgggttcgacacacacgtgcaaagggaacacaatttagctaattacatgttcttcctcatgcatctcattaataaacccgatacggagtatacaggtcaagaaacctacgtatggaacatgtacacacaaagatgttgggactttttccccgtgggagattgtttccgaaagcaatacgaagacctcatgggagaatag

SEQ ID NO: 2 - protein, 5142 aa, Heliothis virescens
  misc_feature (1755)..(1755): Xaa = Ser
  misc_feature (4250)..(4250): Xaa = Thr
MAEAEGGASEQDDVSILRTEDMVCMSCTATGERVCLAAEGLGNRHCFLENIADKNIPPDLSQCVFVIEQALSVRALQELVTAAGSETGKENLGKGTGSGYRTLLYGNAILLRHLNSDMYLACLSTSSSQDKLAFDVGLQQHSQGEACWWTLHPASKQRSEGEKVRVGDDLILVSVAIERYLHTTKENEVSIVNASFHVTHWSVQPYGTGISRMKYVGYVFGGDVLRFFHGGDECLTIPSTWTKDGGQNIVVYKGGSVMSQARSLWRLELARTKWAGGFINWYHPMRIRHITTGRYLGVNDQNELYLVSREEPTTASCAFCLRQEKDDQKQVLEDKDLEVIGAPIIKYGDSTVIVQHSETGLWLSYKSYETKKKGVGKVEEKQAILHEEGKMDDGLDLSRSQEEESMTARVIRKCSSLFTKFINGLETLQENRRHSMFFASVNLGEMVMCLEDLTNYFAQPDEDMEHEEKQNKFRALRNRQDLFQEEGILNLILEAIDKINVVTSQGFLAGFLAGDESGQSWEMISGYLYQLLAAIIKGNHTNCAQFANSNRFNWLFSRLGSQASGEGTGMLDVLHCILIDSPEALNMMRDEHIKVIISLLEKHGRDPKVLDVLCSLCVGNGVAVRSSQNNICDYLLPGKNLLLQTALVDHVSSVRPNIFVGRVEGSAVYRKWYFEVTMDHIEKTTHMMPHLRIGWANTTGYVPYPGGGEKWGGNGVGDDLYSYGFDGAYLWSGGRKTPVNRTHAEEPYIRKGDVIGCALDLTVPIINFMFNGVRVTGSFTNFNLEGMFFPVISCSSKLSCRFLLGGEHGRLRYAAPEGYSPLVESLLPQQILSLEPCFYFGNLSKRALAGPPLVQDDTAFVPTPVDTLQITLPTYVEQIRDKLAENIHEMWAMNKIEAGWMYGDQREDLHKIHPCLVPFERLPPAEKRYDIQLAVQTLKTILALGYYISLDKPPARIRNVRLPNEPFMQSNGYKPAPLDLSAVTLTPKMDELVGQLAENTHNLWARERIQQGWTYGLNEDSDMHRSPHLVPYPKVDDAIKKANRDTASETVRTLLVYGYMLDPPTGEQHEALLLEASKQKQADFRTYRAEKNYAVSSGKWYFEFEILTAGPMRVGWAHADMAPGMMLGQDENSWAFDGYNEEKVYSGNTESFGKQWAVGDVVGVFLDLIDKTISFSLNGELLMDALGGETTFADVQGDNFVPACTLGVGQKARLTYGQDVNTLKYFTTCGLQEGYEPFCVNMKRDVTHWYTKDQPIFENTDEMIDTRIDVTRIPAGSDTPPCLKISHNTFETMEKANWEFLRLSLPVICHNEFIDEAEKARRWVEIKDRQRILMKEAVEAQMSAHIDQIMRSGFTMNDIKGLHYEDNQEELPSSKMKRLPSRPPRKGSMTRGVTIQNYNNLQPGQVNGMHRSTSEAEMAKYDLGAQGLTPDDKKDKRGRSPFKFFRSKRGESSDRAKSRKSKTPDPFSDTEVSPERGARRPNPQIKVSQANQRYNGMNARPSRTNLYGSQVGLNSNAQMATPTQDRKQMTTSTLAQSATETVGNEIFDAECLKLINEYFYGVRIYPGQDPTHMYIGWVTTQYHLHSKDFNQSKVTKSSVIITDDYDRVVENVNRQSCYMVRADELYNEVMAEATAKGASQGMFIGCSVDTSTGSVSFTCEGKDTSFKFKMEPETKLFPAISVEATSKEILQIELGRSATSLPLSAAVLPTSDKHVIPQFPPRLKVQCLKPHQWARVPNQSLQVHALKLSGIRGWXMLCEDAVSMLALHIPEEDRCIDILELIEMDKLLSFHSHTLTLYAALCYQSNYRAAHALCSHADQKQLLYAIQSQYMSGPLRQGFYDLLTALHLESHATTMEACKNEFVIPLGPELKALYEEPDMGHSLRSLQTESVRPQMKMTDIAESITEISNLYSPYFPLEVVREFVMQALAEAVETNQVHNWDPVGGSNENLFLPLIKLVDRLLLVGMMRDEDVEKLLIMTNPETWDPSFDKEGKDEHRKGLLHMKMAEGAKLQMCYLLQHLNDIQLRHRVEATIAFAHDFVGDLQTDQLRRYTEIKQSDLPSAVAAKKTREFRCPPREQMNVILSFKHLEEEDKENCPCGEELIARMNEFHDTLMAHVSLHALQEPDAAENQEPEAKPGAFGKLYNIINTVKELEEEAKAIEEPPKKTPEEKFRKVLIQTIVNWAEESQIETPKLVREMFSLLVRQYDAVGELIRALEKTYVINAKTKLDVAEMWVGLSQIRALLPVQMSQEEEELMRKRLWKLVNNHTFFQHPDLIRVLRVHENVMAVMMNTLGRRAQAQSDAQPSSQPVAEDNKEKDTSHEMVVACCRFLCYFCRTGRQNQKAMFDHFDFLLENSNILLSRPSLRGSTPLDVAYSSLMENTELALALREHYLEKIAVYLSRCGLQSNSELVEKGYPDLGWDPVEGERYLDFLRFCVWVNGESVEENANLVIRLLIRRPECLGPALRGEGEGLLKAIVDANKMSERIADRRKLREMEQEGDVNFSHPLPESDEDEDYIDTGAAILNFYCTLVDLLGRCAPDAGVIALGKNESLRARAILRSLVPLEDLQGVLSLRFTLNNPAAGEERPKSDMPSGLIPGHKQSVGLFLGRVYGIETQELFYKLLEEAFLPDLRAATMLDRNDGCESDMALSMNRYIGNSILPLLIKHAYFYNEAENYASLLDATLHTVYRLSKNRMLTKGQREAVSDFLVALTSAMQPSMLLKLLRKLTVDVSKLSEYTTVALRLLTLHYERCAKYYGSTGAGQGAFGASSDEEKRLTMMLFSSIFDSLSKMDYEPELFGKALPCLIAIGCALPPDYTLSKNYDDEFYGKEQAAGDLDNPQYDPQPINTSSVALNNDLNTIVQKFSEHYHDAWASRKIENGWVYGEGWSDSQKTHPRLKPYNMLNDYEKERYKEPVRESLKALLAIGWSVEHSEVDIPSNNRSSMGRQSKSGGRPPEIVTDSATPFNYNPHPVDMTNLTLSREMQNMAERLADNAHDIWAKKKKEELVTNGGGIHPQLVPYDLLTDKEKKKDRERSQEFLKYLQYQGYKLHRPSKAPQSDTEQTTTGVAIELRFAYSLLEKLIQYIDRATINMKLLKPSTTFSRRSSFKTSTRDIKFFSKVVLPLMEKYFSTHRNYFIAVATATNSVGAASLKEKEMVAALFCKLASLLRSRLAAFGPDVRITVRCLQVLVRGIDAKSLVKNCPEFIRTSMLTFFNNVADDVGHTIMNLQDGKYAHLRGTHLKTSTSLGYIHGVLLPILTAKFDHLANCEYGADLLLDEIQVASYKMLGSLYALGTDASLTHDRKYLKTEIERHKPALGSCLGAFSSTFPVAFQEPHLNKHNQFSLLNRIADHSLEAQDIMQKMEQCMPTLETILGEVDQFVESDKTYNEAPHIIDVVLPLLCSYLPFWWAQGPDNVTPTGGNHVTMVTAEHMNQLLKNVLKLIKKNIGNENAPWMTRIATYTQQIIINSSEELLRDSFLPLAERVRKRTDNMFHKEESLRGFIKSSTDDTSQVESQIQEDWQLLVRDIYSFYPLLIKYVDLQRNHWLRNNVPEAEELYNHVAEIFNIWSKSQYFLKEEQNFISANEIDNMVLIMPTATRRVTAVTDGTPQGGGKKKKKHRDKKRDKDKEVQASLMVACLKRLLPVGLNLFAGREQELVQHCKDRFLKVGTLKKMSEQDVAEFAKTQLTLPDKIDPADEMSWQHYLYSKLGSKSKSNITVETAENKAKIIDDTVERIVAMSKVLFGLHMIDHPQQMSKNVYRSVVSIQRKRAVIACFRQTSLHSLPRHRACNIFARTYYELWLEEENIRQEVMIEDLTQSFEDAELKKSDVVEEGEKPDPLTQLVTTSCRGAMTERSGALQEDPLYMSYAHIIAKSCGEEEEEGGGEEEEGGGEAEAEDEGRASIHEQEMEKQKLLFHQARPADRGVAEMVLLHISASKGLPSEMVMKTLQLGISILRGGNIDIQMGMLNHLKDKKDVGFFTSIAGLMNSCSVLDLDAFERNTKAEGLGVGLEGAAGEKNMHDAEFTCALFRFIQLTCEGHNLDWQNYLRTQAGNTTTVNVVICTVDYLLRLQESIMDFYWHYSSKELIDPAGKANFFKAIGVASQVFNTLTEVIQGPCTQNQQALAHSRLWDAVGGFLFLFSHMQDKLSKHSSQVDLLKELLNPQKDMITMMLSMLEGNVVNGTIVKQMVDTLVGSASNVELILKYFDMFLKLKDLTSSASFQEIDANNDGWVLPKDFKEKMEQQKSYXPEEIEFLLACCETNHDGKLDYIGFCDRFHEPAKEIGFNLAVLLTNLSEHMPNEPRLARFLETAGSVLDYFEPFLGRIEIMGGSKRIERVYFEIKESNIEQWEKPQIKESKRAFFYSIVTEGGDREKLEAFVNFCEDAIFEMTHASGLMAASEESVGGTKNREASYMYMGDDGDERAGKDPFRRGLQSVKDGVATAFSSLSPSNIKAKIADMQQMPPAELAVGFFKMFFYPFYYLGYGVLVVVRYIFGVLLGLMRGPQTDEPPPEPTEEEKIGQLRHRLLATQSSRHLPALPPADDTGQMQVSAFGLDITKEDNGQIQVKPHESPSTSTPSSGGEAEVSPDESADHTEEQRPPSLIDLLGGEQAKKQAQERMEAQAAQQAAMSAIEAESKKAVQGPAPSALSQVDLSQYTRRAVSFLARNFYNLKYVALVLAFCINFVLLFYKVSTLDGEGGEGSGLGDIIAGGGSGSGAGSGSGDGSGETGEDDDALEVVHIDEDFFYMEHVIKMAAVLHSIVSLAILIGYYHLKVPLAIFKREKEIARKLEFDGLYIAEQPEDDDLKSHWDKLVISAKSFPVNYWDKFVKKKVRAKYSETYDFDSISNMLGMEKTSFSAQEEEGSKGLIHYIINIDWRYQVWKAGVTITDNSFLYSLWYFSFSVMGNFNNFFFAAHLLDVAVGFKTLRTILQSVTHNGKQLVLTVMLLTIIVYIYTVIAFNFFRKFYVQGEDDEVNRNCHDMLTCFVFNLYKGVRAGGGIGDELEPPDGDDSEVYRIIFDISFFFFIIVILLAILQGLIIDAFGELRDQLESVKEDMESNCFICGINKDYFDKVPHGFDTHVQREHNLANYMFFLMHLINKPDTEYTGQETYVWNMYTQRCWDFFPVGDCFRKQYEDLMGE

SEQ ID NO: 3 - DNA, 15845 bp, Myzus persicae
  Unsure (36)..(37): n = A, C, G, or T
  misc_feature (5807): n = a or t
ctgtccaccggccgtatactatataggtccgatcgnnactgtgcgctttttattcgcaaacggacagggaccgagcgcggacgagcggacgaacgctgacaaatgcgccgaaatgcgccgccgcacagtgacgcagccgagcgcggtgtccgtttgaaatattattattacagtcgttgaagagccggaacgagcgacgacgtctggtcgtccttataacagcagaagcagccgcacaagcagccgcagcagcagcagaccggccaactcgccgcgatggccgacagcgagggcagttcggaacaggacgatgtctcgtttctccggacggaagatatggtgtgtttatcatgtaccgcgaccggagagagagtttgtcttgcagcagaaggatttggaaatcggcattgttacttagaaaatattgccgataagaatattccacccgatttatcacagtgtgtttttgtcattgaacaagcattatctgtgagggctttacaagaattagtgacagctgcaagttctcaagagggaaaaggcggaactggatctggacaccggacgttactgtacggaaatgctattttattgcgtcatcaaaatagtgatatgtatttagcttgtctatcaacaagttcttcaaatgataaattatcttttgacgttggtttacaagagcattcacaaggtgaagcttgttggtggactgttcatcctgcatcgaaccaacgatcagagggtgaaaaagttccagtcggagatgatttaattttagtgtctgtagcaactgaacggtatttgcacaccgccaaagaaaacgagttatctgtagttaatgcctcatttcatgtaactcattggtcagtacaaccatatggtactggtatcagcagaatgaaatacgttggttatgtgtttggtggtgacgtactaagattctttcatggcggcgacgagtgtttgacaataccgtcgtcatggagcaatgtttctggacaaaatatagtaatttatgaaggcggaagcgttatgagtcaagcaagatcattatggcgtttggagttggctagaactaaatgggccggtgggttcattaattggtaccatccaatgcgaataagacatctgacaactggtcggtatttaggtgtcaatgaaaacaatgaattgcatttagtttgcagagaagaagccaccactgcatcttctacatttttcttacgccaagaaaaagacgaccaaaaaataattttagaggacaaagatctagaagtaattggtgcacctataattaagtatggtgacagcacagtgttagtgcaacattctgatacaggtttatggttaacatataagtcttatgaaacaaaaaaaaaaggtgtcggtaaagtagaagaaaaacaagcagtattacacgaagaaggtaagatggacgatgggttagactttagtaggagtcaagaagaagagtcaagaactgctagagtaatacgcaaatgctcttcattattcacacagtttatttctggattggagaacttacaaagtaacaggcgttcgtcattattttgttcattcgttaatctaaatgaaatggtcatgtgtctagaagatttaataaattactttgctcaacctgaagaggatatggagcacgaagaaaaacaaaaccgatttagagcattaagaaatagacaagatttatttcaagaagaaggaatattaaatttaatcttagaagccattgataaagttaacattatcacatctcagggattcatggtcagtttagccggtgatgagtctggacaaagttgggatgtgatttctggttatttataccagttgttagctgcaattattaaaggaaatcataccaactgtgctcaatttgctaatactaaccgattaaattggttattcagccgtttaggatctcaagcatccagtgaaggaactggtatgttagatgtgcttcattgtgttctcatcgattctccagaagctttaaatatgatgaaagacgaacatattaaagttataatatcacttttggaaaaacatggtcgtgatccaaaagtgttggatgttttatgttctctgtgtgttggtaacggtgtagctgtaagaagttcgcaaaataatatatgtgatttcttattacaaggaaaaaatttacttcttcaaaccttacttgttgaccacgtagcgagcgtacgtcccaatatttttgttggtcatgtaagtggatctgctgtttatagaaaatggtattatgaagtggcaatagatcatgtagaacaaactactcatttaaatccgcacattcgcattggatgggcaaatacagctggttatgttccatatcctggtggtggagaaaaatggggcggaaacggagttggggataatttatactcttttggatttgatggatcatatttatggacaggaggacgtaagtcaggagtgatgcccggaacacaaatttctaacattaaaaaaagtgatgtgattggctgtgcattagatttaactattccaattataacttttacattgaacggtcaacttgtccaaggtgcctttagagacttcaatttagatgggatgtttttcccagtaattagttgttcgtcaaaagtcagttgtcgttttttattgggtggagatcacggtcgattgaagtttactcctccagacgaattttctcccctatttgaaaccttattacctcaacaaattttgacaattgatccctgtttttattttgggaacctaaataaatgcgtgctcacgggtccatggtatgttgaagacggtacagcatttgttccaaatccagttgatacttcgatggtcaccttgcctagttacatagaaaatattaaagacaaattagcagagaatattcacgaaatgtgggcaatgaataaaattgaagctggttggcaatatggcgataaaagaaatgatactaggaagtatcatccatgtttaatacagtttgacaagttgcctccagccgagaagcgttatgattctcaattagctgtgcaaacgcttaaaacggttattgcgttaggttatcacatatctattgataatccaccgtcccgcattaaaacagtccggctgcccaacgaaccatttatgcaatccaatggatataaaccagcaccactagatttatctgctatcattttgtcaggaaaaatggaagaactaattgatcagttagccgggaatacacataatctatgggcaaaagaaagaatacagcaaggatggacatatggattaaatgaagaattacaaatgttgcgcagtcctcatttagtaccgtacagcaaagtagacgacgctattaaaaaagctaatagagatacagcaagcgaaacagtccgcacattattggtatatggttacaatttagatcccccaactggagaaacaaacgaagcgacactcctaacagatgacaactctaatagatatttgacgttcagaacatatcgtgcggaaaaaacgtatgccgtttctagtggaaaatggtacttcgaatttgagatactgacaagtggacctatgcgggttggatgggccaggttcacatgttccccgggttatcaaatcggcagtgatgaaaattcttgggcatttgatggttataacgaagaaaaaatttacatggggacagccgaatcatttggtagacagtggcaagttggagatgtcgtgggagtgtttttagatttaatggaccatacaataagcttttcgatgaacggagaattactaatggatacgttaggaggggaaacaacattctctgaagtccaaggagaaggatttgtacctgcgtttacgctgggactaggacaaaaagcaaaattgacatttggtcaagacgttaactcattgaaatacttcacgacttgtggacttcaagaaggatatgaaccattctgtgtaaatatgaagaggcctgttgcttattggtatactaaggatcaaccaatttttgagaatactgacgatttttcgtctgttattgatgttacaagaataccagctggttcagatacaccaccttgtctaaagataagtcataatacatttgaaaccatggaaaaagccaattgggaatttttacggctatcattacctgtcatatgtctaccaagttttattggcgatcaagaaaaacaaaggggatggcaagaaataagaattaggcaacacaggttattgtcgcaatctgagcatgctactcctgctcatattgaacgaattatgaaatcaggattttcaatgagtgatataaaaggtcttcatcgaggttattcagatgatcctgttgaaaatgacgaaattatgccaaatactgcgcctttaccaccaagagggaaaaatcaaccaccaccacccagaccaccacgaaaggggtcattatcgaggcatgatgacttaacaatcgaaaatgatgggaaattgaatcgttcatctagtgaactgaatttcaacatatataatcatcaaaatggcgatggtcaggatataaacaaagacgataagaaaaagagaggacgttctccatttcgatttttctcgagaaaaaaagaaggaccctcagataacccgaaaagagcaaaaacgccggatccagctaggaatgtagatagaccacgaaatgctgcacacagacctaatacattaaatgaaagagtaaccccccaaataagagtttcacaaatggatttaaaactggtcccaccagctattcctgatagaccaggaggtccaaaagcgatgtcatttacacctacatcagcaggaattgaatttgtgggaaatgaaatatttgatttagaatgtttaaaattaataaatgagtattactatggtgtaagaatattcccgggtcaagaccctacacatgtttacgtgggatgggttactactcaatatcatcttcatactaaagatttcagccaaaaccatgtgcgaaaaagcactgtaacaattgtcgatgaacataatggaattttagaaagcattgatcggcaaagttgttatatggttcgatccgatgaattgtacaatgaagttacaaatgattcatcaggaaaggcagcctctcaaggcatgaccattggttgttttattgacatagctactggactgatgtcatttacatgcgaaggaaaagaaactagttttaaatttaaaatggaaccagacattaagttattccctgcaatatttgtggaagcaagtagcaaagagattttacaaatcgaattgggcagaacttcaaccacacttccattatctgcagctgtcttacaaaattcggaacgtcatgttcttcctcagtttccacctagattaaaagtccaatgtttaagaccacatcagtgggctagagttccaaatgattctttacacattcacactctgaaattatctgatattagaggatggagtatactctgtgaagatccagtgtcgatgattgcactacacattcccgaagaagatcgatgtatagatatcttagagttgattgaaatggagaaattattatctttccatgctcacacattgactttgtacgctgctgtgtgctaccaagccaactaccgagctgctcacatattatgtactcatgtaaatcaaaaacaattgttatatgctatatgttcagaatatatgtctggtccattgcgtcaaggattttatgatctcttaatagctttgcatttagagtcccatgccacaacaatggaggtttgtaaaantgaatacattatacctttgggacatgaattaactaccttgtatgacgatccacaaatgggccatagtttacggtcgttacaaacggaatctgttcgacctcagatgaaaatgactgaaatttcagacgttattgacaatgttcgaaacttatacagtccttattttccattacaagtagtcagagaatatgtaatggctgcccttgaggaagccgtattagttaaccaggttcataatagagatcccattgggggatctaacgaaaatttgtttttaccgttattaaaattagtggatcgtcttttacttgtcggtatgttacgtgacgaggatgtcgaaaaattattaataatgattaaccctgaaacttgggatcctgaatttcaaaaagatggtcctgatgaacatagaaaaggattattgcacatgaaaatggctgagggtgccaaacttcagatgtgttatttattacaccatttatgtgatattcaactaaggcatagggttgaatcgataatctcatttagttaccaatttgtcaatgatatacaaatagatcaattaagaagatataatgaaataaaacaatcagatttaccatctgcagttgctgcaaaaaaaacaagagagttccgatgtccacctcgagaacaaatgaatgcaatattaggttttaaaaatttggacattgatgataaagaaaattgtttgattggtgatgagcttcgtgaaagaatgaacgaatttaatgagagactcatgaagcaaatatctttagtagctcttcaagaatcagaagatgacaaatcagatttgaacaaccttaacaaagaaggtaaaataaaacagttctataattttataaatgctgtgaaagatgaagcgaatgaagatggtcttaatgaacatgaaaaaaaaatacccgaagaaatatttagaaaagttttaatatccactattgtatcatgggctgaagaaactcaaattgaaacaccaaaattagttagagaaatgttcagtttattagttagacaatatgatagtgtgggagaattgattcgcgcgttagagaaaacttatgtaattaattttaaaacaaaagaagatgttgctcaaatgtgggttggacttagtcaaatccgttctttgttgcctgtgcaaatgtcacaagaagaagaagaattgatgcgagaaagattatggaaactggtaaataaccacacatttttccaacatcctgatttaataagagttcttcggatgcacgaaaatgttatggccgttgtgatgaatacaccaggaaggagagctcaagcccaatcacaaccaggcggaactcctgtgacggggcaagatggagaaattgttccaaaagaaaaggatacatcacatgaaatggtcgtagcttgttgtcggttcttgtgttatttttgccgcacatccaggcaaaatcaaaaagcaatgtttgatcatttttcatttttactagaaaatagtaacatattactttctagaccgtcattaagaggaagtacaccactcgatgttgcttactcatcgctcatggaaaataccgaacttgcattagcgttgagggaacattatttggaaaaaatcgcgatatatttatctcggtgtggtttacagtctaattctgaattgattgagaagggatatcctgatttaggctgggatccagtagaaggagaaagatatttagattttttacgattttgcgtctgggtcaacggcgaaagcgtagaggaaaatgcgaatttagttattcggttgcttatacgcaggcctgaatgtttgggccccgcattacgaggagaaggagaaggacttttacgtgccataattgatgctaataaaatgtccgaaaggataacagaaaggaggaagtttttagaagaatcagggaatcaagaaaatattcaactagatcacccacttccggaatcagacgacgatgaagattatattgacacaggagctgccattctgaatttttactgtactcttgttgacttactaggacgttatgcgccagacagttcagtaatttcactgggaaaaaatgaatctttgcgtgcaagagccattcttcgatcattggtaccactcgaagatttacatggtgttcttagtcttagatttacactccagaatccagctgctggtcaagataggccaaagagtgatatgccttcagggttaataccaggacacaaacaaagcattgtactctttttagaacgtgtgtatggtatagaaatgcaagagttatttttcacattactcgaggaggcgtttttgccagatctacgtacagcgacaatgcttgacagaaatgatggacttgaatcagacatggcattggcaatgaatagatatattggaaagtcagtattaccattactcataggtcattcgaaattttatagcgagtctggtaattatgctaatttgttagatgcaacgttacacactgtgtatagattatctaaaaatagaatgttaacaaaagggcagagagaagctgtttcagactttttggtggcattaactagccaaatgcaaccaagtatgttattaaaactactgaggaaacttacggtcgatgtatcaaatctatcggagtatacaactgtagcacttagattgttaactttgcattacgatcggtgtgcaaaatactatggttcaacaggaggtcaaggaatatacggagcttctagtgacgaagaaaagcgattaacgatgatgttattcagtaacatatttgattctttgtcaaaaatggactacgatccagaactttttggaaaagcattaccttgtttatcagcaattggatgtgctttgcccccagattattcattgtcaaaaaatcatgatgatgaatggtatggttcaaaacagaatattcaaggaccttccgatggaccttataatccacaaccaataaatacgaatagcatcgttcttgataatgacttgaactccattgtacataagttctcagaacattatcacgatgcatgggcaaatcgtaaattggaaaatggatgggtttatggagaacaatttaatgatgtcaataaaagtcatcctcggcttaaaccatatatgatgttgagtgaatatgaaaaagaactgtacaaagaaccagtgagagagtctcttaaagcattacttgcaataggatggagtattgaacattcagagaacgatgcacctttgaacaatagaggatctgttagacgtcaatcaaaatcgaatgaaaatgttacaccgtttgactatcatcctaatcccatagacatgactaaccttacactcaccagagaaatgcaaaatatggcggaaagattagcagagaactcccatgatatttgggccaagaagaagaaagaagaagttatgttgtgtggagggggtattcataatcaattggttccatatgatttgctaaccgataaagaaaagaagaaagaccgagagcgatcacaagagtttcttaagtacttgcagtaccaaggttataaattacacagaccaaatcgtaatggaggaccctcggaagctgaacaattggctgctgcgtcaacaggagaacttcgattttctcatagtttgctggaaaaattgattcattacattgacagagcatcaataaatatgaaacttttaaaaccttcgggtacatttagcaggcgttctagtttcaaaatatgtactagagatattaaatttttttccaaagttgtgctaccattagttgagaaatattttagcactcatagaaattacttcataacggttgcaacggcttcaagtgtcttgggcgcagcttcgttaaaggaaaaagaaatggtcgctagtttattttgtaagttagccaatcttttgagatctaagttaatggcctttggagctgatgtccgtataaccgtacgatgtttacaagtacttgtcaaagctattgatgctaagtcactcgtgaaaaactgtcctgaatttataagaacttcaatgcttacattttttcataacattgctgatgatttggaacatacaattcaaaatttgcacgatagtcgttactgctatctacgaggaactcatttgaaaacatcgacttcactattttatgtcaatgatgtaattttgccggttttgtcatcactttttgatcatttagctgcatacgaatacggaaacgagctattgttgaacgaaattcaagtagccgcttataaaatgttgagtagtctgtatacccttggtacagatacatctttgacacatgatagaaaatatttaaaagtacagttggaaagacatcgtccggcttttggtagttgcttaggtgcatttagttcaacgtttcccgtggctttcctggaacctcatctgaataaacacaaccaatattcacttcttaatcgattcgctgatagttcattggaagctcaagatataatgtcaagaacggaaggcactatgcccactcttgaaacggtattaaacgaagttgatcagtttatcgaatcagaaaaaacatatacagacgcaccacatatcattgatgttattttgccattgttgtgttcatacttaccgtactggtgggcacaaggtccagataatgttgctctaaccacaggtaatcatgtcacaatggtgactagtgaacatatgaactgtctattgaaaaatgttttaaaattaataaaaaaaaatattgggaacgataatgctccttggatgacacaaatagcagcttatacacaacaaataattattaattcttcagaagaattattaaaagatccattcttaccacttgcggaacgagttaaaaaacgtacagaaacgttgtaccataaagaagaatcgttaagaggatttataaaatcatctactgacgatacatcccaaattgaagcccaaatacaagaagattggcaattagttgttagggatatatatgcattttacccactcctcataaaatacgtggatcttcaacgcaatcactggttacgtaatagcatatcaaatgctgaagatttatacaatcacgtatctgaaatattcaacatatggtccaaatctcaatactttttacgagaagaacaaaactttatttctgcgaatgaaattgacaacatgatacttattatgccaacagctacacggagatcggctgtcatatcagaaacttcgttaggaggatcaacaggaaagaaaaagaaaaaacatagggataaaaaacgtgataaggaaaaagaaattcaagcatcattgatggttgcttgtcttaaacgattattgccagttggtttaaatttgttcgcaggaagagagcaagaattagttcaacactgcaaggatagattcttaaaaagaatgccagactatgacgtgatacgatttgtcaaaattcaattgacattacctgacaaattggacccagctgacgaaatgtcctggcaacactatttatactcaaagctaggaagcaaaaaagggactcctgaaattaaacctcaacaagtcgacgaggttgcggatagaattgttgctatggctaaagttctttatggattgcacatgattgatcatcctcagcttcaaagcaaggcgatttatcgatcagttgtatcgacgcaacgtaagagagccgtaattgcttgtttccgacaactctcactccacgctttgaccagacaccgtgcagtaaatatatttgttcgttcgttttacgaactttggcttcaagatgaaaatattgggcaagaagtagtgattgaagatctcacgcaatcgtttgaagaagcggaacttaaaaaacgtgacaaggaagaagaagaaggaatggcagatccactaaatcaaatggtcactaccttctgccgaggtgctatgactgagagaagtggtgctttacaagaggaccctctttatatgtcttatgctgatattttagctaaatcttgcggtgaagaagaagaagaaggtaataacgaagaagaaggttctactggtaacggagaagaagaaggcggcgcttctatccacgaacaagaaatggaaaaacaaaaactgttgtttcaccaagctcgattggccaaccgtggtgtcgcagaaatggtattgttacacatatcagcttgcaaaggtataccgagcgaaatggttatgaaaacgcttcaattgggaatcgcagttctacgtggtggtaatttagaaattcaaatgggtatgttaaatcatttaaaagaaaaaaaagatgttggattttttacttcagttgctggtttaatgaactcgtgcagcgttctcgatttggacgcttttgagagaaataccaaagcggagggtttaggagtaggatcggaaggtgctgctggtgaaaaaaatatgcacgatgccgagtttacgtgtactttattcagatttattcaactaacttgtgaaggacataatttagaatggcaaaattatttaaggacacaagcaggaaataccacgactgtaaatgttgtaatttgtacagtggattatttacttaggcttcaggaatctataatggatttttattggcattattcgagcaaagagctaattgacccagcaggaaaagcaaatttcttcaaagcaatcggtgtagccagcctagtttttaatacgctatccgaagtaattcaaggaccgtgtactcaaaatcaacaggcccttgctcattccagattgtgggatgccgttggagggtttttgtttttgttttcacacatgcaagataaattatcgaaacattctagtcaagtagatttattgaaagaacttttaaatttacaaaaagatatgattacgatgatgctgtccatgttagaagggaacgttgttaatggaacaattggtaaacagatggttgacacattagtagaatcggcgtcaaatgtcgagttgattttgaaatatttcgacatgttcctgaaacttaaagatttaactagttcaacaagctttacggaaattgaccccaacaatgatggttgggtacatccaaaagattttaaagaaaaaatggaacaacaaaaaagttacactgcagaggaaattgaatttatgttacaatgttgtgaatctaatcacgatgggaaaattgattacattggctttaccgatcaattccacgagccatccaaagaaattggtttcaatcttgccgttttgttgactaacctatcagaacacatgccaaatgaacctaggttaacgagattcttagaaacagctagcagtgttttgaattatttccagccattccttggaagaattgaaattctcggaggaagtaaacgcatagaacgggtgtactttgaaattaaggaatcaaacatcgaacagtggttaaaaccacaaattagggaatcaaaacgtgcgttcttttattcaatcgtcacagaaggtggtgataaagagaagttagaagcatttgttaatttctgcgaagacgctatatttgaaatgcaacacgccagtggtcttatggcagttgatgatgggtccggtataggtggtggaaaatctagaaaaacatcgtacacttatcttgcagacgacgaagagaacaagacggcgaaagatcccattcgaagaggtatacaggccatcaaatatggattccatctactgttcttcgtgttgtcacccacaaatattaaaaacaaaatcaatgaaattcaacaaatgagtgtcattgaactgattacttcatttttcaaactgtggttttatttaatattctacactggatatagtggagtttacgttttaaggtatatatctcgtattctcatgcaacttatgagtggcacacaatccgaagaaacaactgtagaagtggtagaagaaaagagtggatcgttcagaatgctgcctgcattaccatcttcgggaatagacgaaacaccgtcaacccttacagatagcaataatatgaggaaaaattctggctcgcttgattccaaacatttaaaatcaaccacaggtggtgacgataaagacgagacatcggcagaaaaccacgaaaaagaagacggcgtggatggctcggaactacaagcgtcgtttgttgatctattagtaggcgaatcggctagaaaagattctattgccggccccgaagttttggctcaacaacaagctgttatggcagcagtagaagcagaaatcaaacaaaagaactctgtcgaaaatcctagtgcattttccacgatcgatatcaacgcatacacgcaccgtgcattgagttttttggcaagaaacttttataatttaaaatacgtcgcactagtgttagcgttctgcattaatttcatactgctgttttacaaggtgaccactctggctgatgatttatcagacgacggagatgtgaaggagtttgcactgggttcggctggcataagcaatgacgacatcgacgattcaaatagcacagaaatggccgacgacgatggagcattggaactcgtgcacgtcaatgaggacttcttttacatggcacacgttatgcggcttgcagctttgctccactctctagcctcattggccatgttgatagcatattaccatcttaaagtgccattggccatattcaaacgggaaaaggaaattgccagaagattagaattcgacggcctctacattgttgaacagccggaagatgatgacataaaatcacactgggacaagttggtgatttccgctaagtcatttccagttaattattgggacaagtttgcgaagaaaaaagttcgccaaaagtatagcgagacgtacgattttgattccataagtaattcgttgggcatggagaagacatcgtttagcactcaggaaaatgaagaacggaccggcttaataaattttgttattaatatcgactggaggtatcaagtttggaaagctggggtcacaatcacagacaacgcatttctgtacagtctgtggtatttcacattttcgattctgggaaactttaacaacttcttttttgctgctcatctactggacgtagctgttggattcaaaacacttagaactatcttacagtctgtaactcataacggaaaacagctggtattgaccgtcttgctcttgacgatcattgtgtacatatacacggtcattgcatttaacttcttcaggaagttctacgtgcaagaagaagacgacgaagtggataaaaaatgtcacgacatgttgacgtgtttcgtgttccatctatacaaaggtgtgagagccggtggcggtatcggagacgaaattggatcacccgacggcgacgactacgaagtttacagaataatgtttgacatcacgttcttcttctttgtcatcattatacttttggccatcattcaaggtttgatcattgacgcgttcggagagctgcgtgaccagctggaaagcgtcaaggaggacatggagtccaattgtttcatttgcggtatcggcaaagattatttcgacaaagtgccgcatggtttcgacactcacgtacaagaagaacacaacctcgccaactacatgtttttcctaatgcatttgatcaacaaaccggacacagaatatacaggtcaagaaacgtacgtgtggaacatgtaccagcaacggtgttgggacttcttcccagtgggagactgtttccgcaaacagtacgaagaggagctcggcggcggaggaggcgtctgataatagtgtttttgtgtttgattgggccccggaaatatataatctgttgtgttttattacgcgcaactgtttctcgaccatggctgtataatagtcatcgtccgtggtcattattattattacttttattataaatcaattaaaatattatttcgctgttcgctgttcgattttctcagtagaaacgtatcatatattatagatcaaagcatattataagttatattaaacaaaacataaaaaaaaaaaaaaaataaaaaaaa

SEQ ID NO: 4 - protein, 5101 aa, Myzus persicae
MADSEGSSEQDDVSFLRTEDMVCLSCTATGERVCLAAEGFGNRHCYLENIADKNIPPDLSQCVFVIEQALSVRALQELVTAASSQEGKGGTGSGHRTLLYGNAILLRHQNSDMYLACLSTSSSNDKLSFDVGLQEHSQGEACWWTVHPASNQRSEGEKVPVGDDLILVSVATERYLHTAKENELSVVNASFHVTHWSVQPYGTGISRMKYVGYVFGGDVLRFFHGGDECLTIPSSWSNVSGQNIVIYEGGSVMSQARSLWRLELARTKWAGGFINWYHPMRIRHLTTGRYLGVNENNELHLVCREEATTASSTFFLRQEKDDQKIILEDKDLEVIGAPIIKYGDSTVLVQHSDTGLWLTYKSYETKKKGVGKVEEKQAVLHEEGKMDDGLDFSRSQEEESRTARVIRKCSSLFTQFISGLENLQSNRRSSLFCSFVNLNEMVMCLEDLINYFAQPEEDMEHEEKQNRFRALRNRQDLFQEEGILNLILEAIDKVNIITSQGFMVSLAGDESGQSWDVISGYLYQLLAAIIKGNHTNCAQFANTNRLNWLFSRLGSQASSEGTGMLDVLHCVLIDSPEALNMMKDEHIKVIISLLEKHGRDPKVLDVLCSLCVGNGVAVRSSQNNICDFLLQGKNLLLQTLLVDHVASVRPNIFVGHVSGSAVYRKWYYEVAIDHVEQTTHLNPHIRIGWANTAGYVPYPGGGEKWGGNGVGDNLYSFGFDGSYLWTGGRKSGVMPGTQISNIKKSDVIGCALDLTIPIITFTLNGQLVQGAFRDFNLDGMFFPVISCSSKVSCRFLLGGDHGRLKFTPPDEFSPLFETLLPQQILTIDPCFYFGNLNKCVLTGPWYVEDGTAFVPNPVDTSMVTLPSYIENIKDKLAENIHEMWAMNKIEAGWQYGDKRNDTRKYHPCLIQFDKLPPAEKRYDSQLAVQTLKTVIALGYHISIDNPPSRIKTVRLPNEPFMQSNGYKPAPLDLSAIILSGKMEELIDQLAGNTHNLWAKERIQQGWTYGLNEELQMLRSPHLVPYSKVDDAIKKANRDTASETVRTLLVYGYNLDPPTGETNEATLLTDDNSNRYLTFRTYRAEKTYAVSSGKWYFEFEILTSGPMRVGWARFTCSPGYQIGSDENSWAFDGYNEEKIYMGTAESFGRQWQVGDVVGVFLDLMDHTISFSMNGELLMDTLGGETTFSEVQGEGFVPAFTLGLGQKAKLTFGQDVNSLKYFTTCGLQEGYEPFCVNMKRPVAYWYTKDQPIFENTDDFSSVIDVTRIPAGSDTPPCLKISHNTFETMEKANWEFLRLSLPVICLPSFIGDQEKQRGWQEIRIRQHRLLSQSEHATPAHIERIMKSGFSMSDIKGLHRGYSDDPVENDEIMPNTAPLPPRGKNQPPPPRPPRKGSLSRHDDLTIENDGKLNRSSSELNFNIYNHQNGDGQDINKDDKKKRGRSPFRFFSRKKEGPSDNPKRAKTPDPARNVDRPRNAAHRPNTLNERVTPQIRVSQMDLKLVPPAIPDRPGGPKAMSFTPTSAGIEFVGNEIFDLECLKLINEYYYGVRIFPGQDPTHVYVGWVTTQYHLHTKDFSQNHVRKSTVTIVDEHNGILESIDRQSCYMVRSDELYNEVTNDSSGKAASQGMTIGCFIDIATGLMSFTCEGKETSFKFKMEPDIKLFPAIFVEASSKEILQIELGRTSTTLPLSAAVLQNSERHVLPQFPPRLKVQCLRPHQWARVPNDSLHIHTLKLSDIRGWSILCEDPVSMIALHIPEEDRCIDILELIEMEKLLSFHAHTLTLYAAVCYQANYRAAHILCTHVNQKQLLYAICSEYMSGPLRQGFYDLLIALHLESHATTMEVCKIEYIIPLGHELTTLYDDPQMGHSLRSLQTESVRPQMKMTEISDVIDNVRNLYSPYFPLQVVREYVMAALEEAVLVNQVHNRDPIGGSNENLFLPLLKLVDRLLLVGMLRDEDVEKLLIMINPETWDPEFQKDGPDEHRKGLLHMKMAEGAKLQMCYLLHHLCDIQLRHRVESIISFSYQFVNDIQIDQLRRYNEIKQSDLPSAVAAKKTREFRCPPREQMNAILGFKNLDIDDKENCLIGDELRERMNEFNERLMKQISLVALQESEDDKSDLNNLNKEGKIKQFYNFINAVKDEANEDGLNEHEKKIPEEIFRKVLISTIVSWAEETQIETPKLVREMFSLLVRQYDSVGELIRALEKTYVINFKTKEDVAQMWVGLSQIRSLLPVQMSQEEEELMRERLWKLVNNHTFFQHPDLIRVLRMHENVMAVVMNTPGRRAQAQSQPGGTPVTGQDGEIVPKEKDTSHEMVVACCRFLCYFCRTSRQNQKAMFDHFSFLLENSNILLSRPSLRGSTPLDVAYSSLMENTELALALREHYLEKIAIYLSRCGLQSNSELIEKGYPDLGWDPVEGERYLDFLRFCVWVNGESVEENANLVIRLLIRRPECLGPALRGEGEGLLRAIIDANKMSERITERRKFLEESGNQENIQLDHPLPESDDDEDYIDTGAAILNFYCTLVDLLGRYAPDSSVISLGKNESLRARAILRSLVPLEDLHGVLSLRFTLQNPAAGQDRPKSDMPSGLIPGHKQSIVLFLERVYGIEMQELFFTLLEEAFLPDLRTATMLDRNDGLESDMALAMNRYIGKSVLPLLIGHSKFYSESGNYANLLDATLHTVYRLSKNRMLTKGQREAVSDFLVALTSQMQPSMLLKLLRKLTVDVSNLSEYTTVALRLLTLHYDRCAKYYGSTGGQGIYGASSDEEKRLTMMLFSNIFDSLSKMDYDPELFGKALPCLSAIGCALPPDYSLSKNHDDEWYGSKQNIQGPSDGPYNPQPINTNSIVLDNDLNSIVHKFSEHYHDAWANRKLENGWVYGEQFNDVNKSHPRLKPYMMLSEYEKELYKEPVRESLKALLAIGWSIEHSENDAPLNNRGSVRRQSKSNENVTPFDYHPNPIDMTNLTLTREMQNMAERLAENSHDIWAKKKKEEVMLCGGGIHNQLVPYDLLTDKEKKKDRERSQEFLKYLQYQGYKLHRPNRNGGPSEAEQLAAASTGELRFSHSLLEKLIHYIDRASINMKLLKPSGTFSRRSSFKICTRDIKFFSKVVLPLVEKYFSTHRNYFITVATASSVLGAASLKEKEMVASLFCKLANLLRSKLMAFGADVRITVRCLQVLVKAIDAKSLVKNCPEFIRTSMLTFFHNIADDLEHTIQNLHDSRYCYLRGTHLKTSTSLFYVNDVILPVLSSLFDHLAAYEYGNELLLNEIQVAAYKMLSSLYTLGTDTSLTHDRKYLKVQLERHRPAFGSCLGAFSSTFPVAFLEPHLNKHNQYSLLNRFADSSLEAQDIMSRTEGTMPTLETVLNEVDQFIESEKTYTDAPHIIDVILPLLCSYLPYWWAQGPDNVALTTGNHVTMVTSEHMNCLLKNVLKLIKKNIGNDNAPWMTQIAAYTQQIIINSSEELLKDPFLPLAERVKKRTETLYHKEESLRGFIKSSTDDTSQIEAQIQEDWQLVVRDIYAFYPLLIKYVDLQRNHWLRNSISNAEDLYNHVSEIFNIWSKSQYFLREEQNFISANEIDNMILIMPTATRRSAVISETSLGGSTGKKKKKHRDKKRDKEKEIQASLMVACLKRLLPVGLNLFAGREQELVQHCKDRFLKRMPDYDVIRFVKIQLTLPDKLDPADEMSWQHYLYSKLGSKKGTPEIKPQQVDEVADRIVAMAKVLYGLHMIDHPQLQSKAIYRSVVSTQRKRAVIACFRQLSLHALTRHRAVNIFVRSFYELWLQDENIGQEVVIEDLTQSFEEAELKKRDKEEEEGMADPLNQMVTTFCRGAMTERSGALQEDPLYMSYADILAKSCGEEEEEGNNEEEGSTGNGEEEGGASIHEQEMEKQKLLFHQARLANRGVAEMVLLHISACKGIPSEMVMKTLQLGIAVLRGGNLEIQMGMLNHLKEKKDVGFFTSVAGLMNSCSVLDLDAFERNTKAEGLGVGSEGAAGEKNMHDAEFTCTLFRFIQLTCEGHNLEWQNYLRTQAGNTTTVNVVICTVDYLLRLQESIMDFYWHYSSKELIDPAGKANFFKAIGVASLVFNTLSEVIQGPCTQNQQALAHSRLWDAVGGFLFLFSHMQDKLSKHSSQVDLLKELLNLQKDMITMMLSMLEGNVVNGTIGKQMVDTLVESASNVELILKYFDMFLKLKDLTSSTSFTEIDPNNDGWVHPKDFKEKMEQQKSYTAEEIEFMLQCCESNHDGKIDYIGFTDQFHEPSKEIGFNLAVLLTNLSEHMPNEPRLTRFLETASSVLNYFQPFLGRIEILGGSKRIERVYFEIKESNIEQWLKPQIRESKRAFFYSIVTEGGDKEKLEAFVNFCEDAIFEMQHASGLMAVDDGSGIGGGKSRKTSYTYLADDEENKTAKDPIRRGIQAIKYGFHLLFFVLSPTNIKNKINEIQQMSVIELITSFFKLWFYLIFYTGYSGVYVLRYISRILMQLMSGTQSEETTVEVVEEKSGSFRMLPALPSSGIDETPSTLTDSNNMRKNSGSLDSKHLKSTTGGDDKDETSAENHEKEDGVDGSELQASFVDLLVGESARKDSIAGPEVLAQQQAVMAAVEAEIKQKNSVENPSAFSTIDINAYTHRALSFLARNFYNLKYVALVLAFCINFILLFYKVTTLADDLSDDGDVKEFALGSAGISNDDIDDSNSTEMADDDGALELVHVNEDFFYMAHVMRLAALLHSLASLAMLIAYYHLKVPLAIFKREKEIARRLEFDGLYIVEQPEDDDIKSHWDKLVISAKSFPVNYWDKFAKKKVRQKYSETYDFDSISNSLGMEKTSFSTQENEERTGLINFVINIDWRYQVWKAGVTITDNAFLYSLWYFTFSILGNFNNFFFAAHLLDVAVGFKTLRTILQSVTHNGKQLVLTVLLLTIIVYIYTVIAFNFFRKFYVQEEDDEVDKKCHDMLTCFVFHLYKGVRAGGGIGDEIGSPDGDDYEVYRIMFDITFFFFVIIILLAIIQGLIIDAFGELRDQLESVKEDMESNCFICGIGKDYFDKVPHGFDTHVQEEHNLANYMFFLMHLINKPDTEYTGQETYVWNMYQQRCWDFFPVGDCFRKQYEEELGGGGGV

SEQ ID NO: 5 - DNA, 15315 bp, Periplaneta americana
  CDS (1)..(15312)
atggccgacagcgagggaagttcggaacaggacgatgtgtcgtttctccggaccgaagatatggtgtgtttatcatgcactgcgactggagaaagagtttgtcttgcagctgaaggatttggaaatcggcactgttacttggaaaatattgccgataaaaatattccacccgacttgtctcagtgtgtatttgtcattgaacaagcattatcagtgagagctttacaagaactagttacagctacaagttctcaagaaggaaaaggtggaactggatctggacaccgaacattgttgtatggaaatgctattttattacgtcatcaaaatagcgatatgtatttagcttgtttatcaacaagttcgtcaaatgataaattatcttttgacgttggtttacaagagcattcacaaggtgaagcttgttggtggactgtgcatccagcatcgaaacaacgatcagagggtgaaaaagttagagttggagatgatctaattttagtgtctgtggcaactgaacggtatttgcacaccgccaaagaaaatgagttatctgtagttaatgcatcatttcacgtaactcattggtcagtacaaccatatggtactggtatcagtagaatgaaatacgttggttatgtttttggtggagacgtactaagattctttcatggcggtgatgagtgcttgacaataccgtcgacgtggagcaatgtatctggacaaaatatagtaatttatgaaggcggaagcgttatgagtcaagcaaggtcattatggcgtttggaattggctagaactaaatgggctggtggattcattaattggtatcatccaatgcgaataagacatttgacaaccggacggtatttaggtgtcaatgaaaacaatgagttacatttagtttgcagagaagaagccaccactgcttcatctacattttttttacgtcaagagaaagacgatcaaaaaataattttagaagacaaagatttagaagtaattggagcacctattattaagtatggtgacagtacggtattagtacaacattctgatacaggtttatggttaacatacaagtcttatgaaacaaaaaaaaaaggcgtcggtaaagtagaagaaaaacaagcagtattacatgaagaaggtaaaatggacgatgggttagactttagtaggagtcaagaagaagagtctagaactgctagagtgatacgtaaatgctcctcattattcacacagtttatttccggactggaaaatttacaaagtaacagacgttcgtcattattttgttcattcgttaatctaaatgaaatggtcatgtgtctagaagatttaataaattattttgctcaacctgaagaagatatggaacacgaagaaaaacaaaatcgatttagagcattaagaaatagacaagatttatttcaagaagaaggcatattaaatctgattctagaagctattgataaagttaatattattacgtcacaaggatttatggtcagtttagctggtgatgagtctggacaaagttgggatgtgatttctggttatttataccagttgctagctgcaattataaagggaaatcatactaattgtgctcaatttgctaacactaaccgattaaattggttatttagtcgattaggatctcaagcatccagtgagggaactggtatgttagatgtacttcactgtgttctcattgattctccggaagctttaaatatgatgaaagatgaacatataaaagtaataatatctcttttggaaaaacatggtcgtgatccaaaagtgttagacgttttatgttccctatgcgttggtaacggtgtggccgtaagaagttcacaaaataatatatgtgatttcttattaccaggaaaaaatttacttcttcagaccttacttgttgatcatgtagccagtgtacgtcccaatatttttgttggtcatgttagtggatctgccgtttatcgaaaatggtattatgaagtagcaatagatcatgtagaacaaactacacatttaaatccacacattcgaattggatgggcaaatactgcaggttatgttccgtatcctggtggcggagaaaaatggggtggaaatggcgttggggatgatttatattctttcggatttgatgggtcatatttatggacaggaggacgtaaatcagaagtgatgcctggttcagaaatttctaacattaaaaaaggtgatgtaatcggttgtgcattagatttaactattccaattataacttttacattgaacggtcaattggtccaaggagccttcagagacttcaatttagatgggatgtttttcccagtaattagttgttcatcaaaagtcggctgtcgttttttattgggcggagatcatggtcgattgaagtttactcctccagacgaattttctcctctatttgaaagtttattacctcaacaaattttgacaatcgatccgtgcttctattttggaaatcttagtaaatgcgtactcacgggaccgtggtatgttgaagatgatacagcatttgttccaaatccagttgatacatcaatggtcactttacctagttacatagaaaatattaaagataaattagcagagaatattcatgaaatgtgggcaatgaataaaattgaagctggttggcaatatggtgataaaagaaatgatactaggaaatatcatccatgtttaatacagtttgacaagttgcctccagccgagaagcgttatgattctcaattagctgtgcaaacgcttaaaacggttattgcgttgggatatcacatatccatcgataatccaccgtcccgcattaaaacggtacggttgcccaacgaaccatttatgcaatccaatggttacaaaccagcaccactagatttatctgcaataaatttgtcagggaaaatggaagaattaattgaccagttagctgagaatacacataatttatgggcaaaagaaagaatacaacaaggatggacgtatggtttaaatgaagaattacaaatgttacgcagtcctcatttagtaccgtacagcaaagtagatgacgctattaaaaaagctaatagagatacagcaagtgaaacagtccgcactttattagtatatggttacaacttagacccaccgactggagaaacaaacgaagcgacactcctaacagacgaaaacactaatagatacttgacgttcagaacatatcgtgctgaaaaaacatatgctgttgcaagtggaaaatggtatttcgagtttgagatattgacaaacgggcccatgcgagttggatgggccaggtttacatgttctccgggttatcaaatcggtagtgacgaaaattcttgggcatttgatggttataacgaagaaaaaatttatatgggcacagccgaatcatttgggaggcagtggcaagttggagatgtcgtgggagtgtttttagacctaatggatcatacaataagtttttcgttgaatggagaattactaatggatacattgggaggagaaactacgttttctgaagttcaaggagaaggatttgtacctgcatttactctgggactaggacaaaaagcaaaattaacttttggtcaagacgtaaactcattgaaatacttcacgacttgtggtcttcaagaaggatatgaaccattttgcgtaaacatgaagagaccagtaacatattggtatactaaggatcaaccaatatttgaaaatactgatgacttttcgtctgtaattgatgttacaagaattccagctggttcagatacaccaccgtgtctaaaaataagtcataatacatttgaaaccatggaaagagctaattgggaatttttacggctatctttgcctgtcatatgtctaccaaattttattgatgaacaagaaaaacaaaggagatggcaagaaatcagaattaggcagcacaggttattgtcacaatctgagcatgctactcctgctcatattgaacaaataatgaaatcaggattttcaatgagtgatataaaaggtcttcatcgaggttattcggatgatcctgtagaaaacgatgaaatgatgccaaacactgcacctttaccaccaagaggaaaaaatcaaccaccaccacccagaccaccacgaaaagggtctttatctagacacgatgacttaacgatcgaaaatgacggaaagttgaatcgttcatctagtgaattgaattttaacatatataatcagcaaaacggtaatggccaggacataaacaaagatgacaagaaaaaaagaggacgttctccatttcgatttttctcgagaaaaaaagaagggccttcggataatcctaaaagagcaaaaactccggatccagctagaaatgtggttagatcacgtaatgctgctcacagacctaatacattaaatgaaagaataactccccaaataagagtttcacaaatggacttaaaattggttccaccagctattcctgatagaccaggaggtccaaaagcaatgtcatttacaccttcatcagcagggattgaattcgtgggaaatgaaatatttgatttagaatgtttaaaattaataaacgagtattactatggtgtaagaatatttcccggccaagaccctacacacgtttacgtgggatgggttactactcaatttcatctccatagtaaagatttcagtcaaaatcatgttcgaaaaagtactgttacaattgtcgatgaacataatagaattttagaaagtattgatcgacaaagctgttacatggttcgatccgatgagttatacaacgaagtaacaaatgattcgtcggggaagggagcatctcaaggaatggctataggttgttttattgatatagctactggagtgatgtcatttacatgtgaaggaaaagaaactagttttaaatttaaaatggaaccagatattaaattattccctgcaatatttgtggaagctagtagcaaagagatattacaaattgaattgggtagaacttctactacacttccattatctgcagctgttttacaaaattcagaacgccatgttcttcctcagtttccaccgagattaaaagttcaatgtttaagaccacatcaatgggctagagttccaaatgattctttacacattcatactctgaaattatctgacattagagggtggagtatactttgtgaagaccctgtgtcgatgattgcattacacattcccgaagaagatcgatgtatagatattttagagttgattgaaatggagaaattactatctttccatgctcacacgttgactttatatgcagctgtgtgctatcaagctaactaccgagctgctcacatattatgcactcatgtaaatcaaaaacaattgttatatgctatatgttcagaatatatgtctggtccattgcgtcaaggattttatgatctcttaatagctttacatttagagtcccatgcaacaacaatggaggtttgtaaaaatgaatacattataccattggggcatgaactaactgctttatacgatgatccacaaatgggtcatagcttacggtcgttacaaactgaatctgttcgacctcaaatgaaaatgactgaaatttcagacgttattgacaatgttcgaaacttatacagtccttatttcccattgcaagtagttagagaatatgtaatggcagccctagaagaagcagtgttagttaatcaggttcataatagagatcctattggtggatctaatgaaaacttgtttttaccattattaaaattagtggatcgtcttttacttgtcggtatgttacgtgatgaagatgtagaaaaattattgataatgattaatccagaaacttgggatcctgaatttcaaaaagatggtcccgatgaacatagaaaaggtttattacacatgaaaatggctgagggtgcaaaacttcaaatgtgttatttattacatcatttatgtgatattcaactgaggcatagggttgaatcgataatctcttttagttatcaatttgtcaatgatatacaaatagatcaattaagaagatataatgaaataaaacaatcagatttaccatctgctgttgctgcaaaaaagacgagagagttccgatgtccgcctcgtgaacaaatgaatgcaatactaggctttaaaaatttggatagtgatgataaagaaaattgtttgataggtgatgaacttcgtgaaagaatgaacgaatttaatgagaaactcatgaaacaaatattattagtagctcttcaagaatcagaagatgacaaattagatttgaataacataaacagagaaggtaaaataaaacaattttataactttataaatgcagtgaaagatgaagcaaatgaaaatggtctgaacgaacatgaaaaaaaaataccagaagaaatatttagaaaagttttaataaccactattgtatcatgggctgaagaaactcaaattgaaacaccaaaattagttagagaaatgttcagtttattggttaggcagtatgatagtgtaggagaattgattcgtgcattagagaaaacatatgtaattaattttaaaacaaaagaagatgttgctcaaatgtgggttggacttagtcaaatccgttctttgttgccagtgcaaatgtcacaagaagaagaagaattgatgagagaacgattatggaaactggtaaataaccacacatttttccaacatcctgatttaataagagttcttcggatgcacgaaaatgttatggctgtcatgatgaatacactgggaagaagagctcaagcccaatcgcaaccaggtggaactactgtaacgggacaagatggagaaatcgttccgaaagaaaaggatacatcacatgaaatggtcgtagcttgttgtcggttcttatgttatttttgccgtacatccaggcaaaaccaaaaagccatgtttgaccatttttcatttttattagaaaatagtaacatattgctctctagaccgtcactaagaggaagtacaccactcgatgttgcttattcgtcactcatggaaaatactgaacttgcattagcgttgagagaacattatttggaaaagatcgcgatatatttgtctcgatgtggtttgcaatctaattctgaattgattgagaaaggatatcctgatttaggatgggacccagtggaaggagaaagatatttagactttctacgattttgtgtttgggtcaacggtgaaagtgtagaggaaaatgcaaatttagttattcgtttgcttattcgcaggcctgagtgtttgggtcctgcattaagaggagaaggagaaggacttttacgtgccataattgatgcaaataaaatgtctgaaagaatagcagaacgaagaaagttcttagaagaatcggggaaccaagaaaatattcaattagatcatccgcttccggaatccgaggacgatgaagattatattgatacgggagctgccattttaaatttttactgtactcttgttgacttactaggacgatgtgcaccggacagttcagtaattgcactggggaagaatgaatctttacgtgcaagagccattctgagatcattagtaccacttgaagatttacacggtgttcttagtcttagatttacattacagaatccagctgctggtcaagatcgaccaaagagtgatatgccctcagggttaataccaggacacaaacaaagtgttgttctctttttagaacgagtgtatggtatcgaaatgcaagagttatttttcacattactagaggaagcatttttaccagatctacgtacagcaacaatgcttgatagaaatgatggacttgaatcagacatggcattggcaatgaatagatatattggaaattcagtattaccgttactcattggtcattcaaaattctatagcgagtccgataactatgctaatttgttagatgcaacgttacacactgtgtatagattatccaaaaatagaatgttaacaaaagggcagcgagaagctgtttcagactttttagtagcattaactagtcaaatgcaaccaagtatgttattaaaactactgagaaaacttacggttgatgtttcaaatttatcagagtatactactgtagcgcttagattgttaactttgcattacgatcgatgtgcaaaatactatggatcaacaggtggtcaaggaatttacggagcttctagcgacgaagaaaaaagattaaccatgatgttattcagtaacatatttgattccttgtcaaaaatggactacgatccagaacttttcggaaaagcattaccttgcctatcagcaattggatgtgctttgcctccagattattcactgtcaaaaaattatgatgacgagtggtatggttcgaaacagaatattcaaggcccttctgatggaccttacaatccacaaccaataaacacgaatagcattgttcttgataatgacttgaactctattgtacataagttctcagaacattatcatgatgcatgggcaaatcgtaaattggaaaatgggtgggtttatggagaacaatttaatgatgttaataaaagtcatcctcgtctaaaaccatacatgatgttgagtgaatacgaaaaagaactatacaaagaacctgtgagagagtcccttaaagcattacttgcaataggatggagtattgaacattcagagaacgatgcaccattgaataatagaggatctgttcgacgtcaatcaaagtctaatgagaatgtaacgccgtttgactaccatccgaatcccatagatatgactaaccttacactcactagagaaatgcaaaatatggcggaaagattagcagaaaactcccatgacatttgggctaagaagaaaaaagaagaagttatgttgtgtggaggaggtattcataatcaattggttccgtatgatttgctgaccgataaagaaaagaaaaaagatcgagaacgctcacaagagttccttaaatatttgcagtatcaaggttataaattacacagaccgaatcgtaatggaggaccttcagatgctgaacaattggctgctgcatcaacaggggaacttcgattttcttacagtttattagaaaaattgattcattacattgacagagcgtctataaacatgacacttttaaagccttcaggcacatttagcaggcgttctagtttcaaaatctgtacaagagatattaaatttttctccaaagttgtgctaccgttagttgagaaatattttagcactcatagaaattacttcataacggttgcgacagcttcaagtgttttgggtgcagcttcgttaaaggaaaaagaaatggtcgctagtttattttgtaagttggcaaatcttttgagatctaagttaatggcctttggagctgatgtccgtataaccgtacgatgtctacaagtgcttgtcaaagctattgatgctaagtcactcgtaaaaaactgtcctgagtttattagaacttcaatgcttacatttttccataacatcgctgatgatttggaacatacaattcaaaatttgcatgatagtcgttattgttatttgagaggaactcatttgaaaacatcaacttcattattttatgttaatgacgtaattttaccagttttatcatcgctttttgatcatttagctgcatatgaatatggaaacgagctattgttaaatgaaattcaagtagcagcttataaaatgttgagtagtttatatactcttggcacagatacatctttaacgcatgatagaaaatatttaaaagtacagttggaaagacatcgtccggcgtttggtagttgcttgggtgcatttagttcaacatttcctgtggctttccttgaaccacatctgaataaacacaatcaatattcgcttcttaatcgatttgctgacagttcattggaagctcaggatataatgtctagaatggaaggcactatgcctactctagaaactgtattaaatgaagttgaccagtttgtcgaatcagaaaaaacatatgctgatgcacctcacattattgatgttattttacctttattgtgttcatacttaccgtactggtgggcacaaggtccagataatgttgctctgaccacaggtaatcatgttacaatggtgaccagcgaacatatgaactgtctattaaaaaatgttttaaagttaataaaaaaaaatattggaaatgataatgccccttggatgacacaaatagcagcttatacacaacaaataattattaattcttcagaagaattattaaaagatccatttctaccacttgcagaacgagttaaaaaacgtacagaaacattataccataaagaagaatcattaagaggatttataaaatcatctactgatgatacgtcccaaatcgaagcacaaatacaagaagattggcaattggttgttagggatatttatgctttttatccactcctcataaaatacgtggatcctcagcgcaatcactggctacgtaataacatatcaaatgctgaagatttatacaatcatgtctctgaaatatttaacatttggtccaaatcgcaatactttttacgtgaagaacaaaactttatatctgcaaatgaaattgataacatgatacttattatgccaacggcaactcggagatcggctgttatatcagaaacttcgttaggagggtcatctggaaagaaaaagaaaaaacacagggataaaaaacgtgacaaagaaaaagaaattcaagcttcattgatggtggcttgtcttaaacgattactgccagttggtttaaatttgttcgcgggaagagaacaagaattagttcaacattgcaaggatagattcttaaaaaaaatgccagattatgatgtgatacaatttgtcaaaattcaattgacattacccgataaattagacccagctgacgaaatgtcctggcagcactatttatactccaagttaggaagcaaaaaaggaaatactgaaattaaaccacaacaagtcgacgaggtagcggatagaattgtcgctatggctaaagttctttatggattgcatatgattgatcatcctcagcttcaaagcaaggcgacttatcgatctgttgtatcgacgcaacgtaagagagccgtaattgcttgtttccgacaactctcactccacgctttgaccagacaccgtgcagtaaatatattcgttcgttcgttttacgaactttggcttcaagatgaaaatattggacaagaagttatgattgaagatctcacacaatcatttgaagaagcggaacttaaaaaacgtgacaaggaagaagaagaaggaatggcagacccattaaatcaaatggttacaactttctgccgaggagccatgactgaaagaagtggtgctttacaagaggaccctctttacatgtcttatgctgatattttggctaagtcctgcggcgaagaagaagaagaaggtaataacgaagaagaaggttcaaatggtaacggagatgaagaaggcggtgcttctatccatgagcaagaaatggaaaaacaaaagcttttgtttcaccaagctcgattggctaaccgtggtgtcgcagaaatggttttattacacatatcagcttgcaaaggtatacccagtgaaatggttatgaaaacgcttcaattgggaatcgcagttctccgtggtggtaatttagacattcaaatgggaatgttaaatcatttaaaagaaaagaaagatgttggattttttacttcagttgctggtttaatgaactcatgcagcgttcttgatttggacgcttttgagagaaataccaaagcagaaggtttgggagtaggatcggaaggtgctgctggtgaaaaaaatatgcatgatgcagagttcacgtgtactctatttagatttattcaattaacttgtgaaggacataatttagaatggcaaaattgtttaagaacccaagcaggaaataccacaactgtaaatgttgcaatttgtacagtggattatttacttaggcttcaggaatctataatggatttttattggcattattcgagtaaagagttaatcgatccagcaggaaaagcaaatttcttcaaagcaatcggtgtcgccagccaagtgtttaatacactatccgaagtaattcaaggaccatgtactcaaaatcaacaggccctagctcattccaggttgtgggatgctgttggagggtttttgtttttattttcacacatgcaagataaattatcgaaacattctagtcaagtagatttactaaaagaacttttgaatttacaaaaagatatgattacgatgatgctgtcaatgttagaaggaaatgttgttaatggaacaattggtaaacaaatggttgacactctagtagagtcggcgtcaaatgtcgagttgatattgaaatattttgacatgttcctgaaacttaaagatttaacgagttcaacaagctttacggaaattgaccccaataacgatggttgggtacatcccaaagattttaaagaaaaaatggaacaacaaaaaagttatactgcggaggaaattgaatttatgttacaatgttgtgaatctaatcatgatggaaaaattgattacattggcttcactgatcaattccacgagccatctaaagaaattggttttaatcttgccgtattattaactaatctatcagaacatatgccaaatgaacctagattaacaagattcctagaaacagctagcagtgttttgaactatttccaaccgttcctgggtagaattgaaattcttggaggaagtaagcgtatagaacgggtgtactttgaaattaaagaatcaaatatcgaacagtggttaaaacctcaaattagggaatctaaacgagcgttcttttattcaatcgttaccgagggtggtgataaagaaaaattagaagcattcgttaatttctgtgaggatgctatatttgaaatgcaacacgctagtggtcttatggcagtcgatgacggatccggtataggtggtggaaaatctagaaaaacagcttacatttatcttgcagatgacgaagaaaacaagacggcaaaagatcccattcgaagaggcatacaggccatcaaatatggattccaactattgtttttcgtgttgtcacccactaatattaaaaacaaaatcaatgaaattcaacaaatgagtttcgttgaactgatcacttcgtttttcaaactctggttttatttaatattctacactggatacagtggagtttatgtgttaaggtatatatctcgtattctcatgcaactaatgagtggcacgcaatccgaagaaacaactgtagaagttgtagaaaaaagagccggatcgttcagaatgctacctgcattaccatcttcgggagtagatgaaccgccgtccactttaatagacagtagtaatatgagaaaaaattctggtgcacctgattcaaaacatgtaaaatcaaccacagtcggagacgataaagacgaaacgtcgacagaaaatcatgaaaaagaagacggtgtgaaatcggaagataactcggaactacaagcatcgtttgttgatctattagtaggcgagtcggctagaaaagattctattgccggccctgaagttttggctcaacaacaagctgttatggcagctgtagaagcagaaatcaaacaaaagaactctgtcgaaaatcctagtgcattttctacgatcgatatcaacgcatacactcaccgtgctttaagttttttggcaagaaacttttataatttaaaatacgttgcactagtattagcattctgcattaatttcatactactcttttacaaggtgacaactcttgccgaagatttatcagacgacggagacagcaaagattttgcactgggttcggctggcataagcaatgacgatatcgacgattcgaatagtaccgaaatagccgatgacgatggagcattggaacttgtacatgtcaacgaggacttcttttacatggcacacgttatgcgacttgcggctttgcttcactcgctggcctcattagcaatgttgattgcatactaccatttgaaagtgccattggccatattcaaacgggaaaaagaaatcgcgaggagattagaattcgacggcctatacattgttgaacaaccagaagacgatgacataaaatcacactgggacaagttggtgatctccgccaagtcgtttccggtgaattattgggacaagtttgcaaagaaaaaagttcgtcaaaagtatagtgagacgtacgattttgattccataagtaatttattgggcatggaaaagacatcatttagcactcaagaaaatgaagaacggacgggcttaataaattttgttattaatatcgattggagatatcaagtatggaaagctggagtcacaataacagacaacgcattcctgtacagtctgtggtatttcacattttcgattctgggaaactttaacaatttcttttttgccgctcatctactggacgtggccgttggctttaaaacgctaagaactatcttgcagtccgtaactcataacggaaaacagctagtattgaccgttttgcttttaacgatcatagtatacatatacacagttattgcatttaacttcttcaggaagttctatatccgagaagaagatgacgaagtggataaaaaatgtcacgacatgttaacgtgtttcgtgttccatctttacaaaggtgtgagagccggtggtggtatcggagacgaaatcggatcacctgacggcgatgattacgaagtttacagaataatgtttgatattacattctttttcttcgtcatcattatacttttggccatcattcaaggtttgatcattgacgcgttcggagagctgcgtgaccaactggaaagcgtcaaagaggacatggaatccaattgtttcatctgcggcatcggcaaagattatttcgacaaagttccgcacggttttgacacgcacgttcaagaagaacacaaccttgctaactacatgtttttcctaatgcatctgatcaacaaaccggacacggaatataccggccaagaaacgtacgtctggaacatgtatcagcaacggtgttgggacttcttcccggtaggagactgtttccgtaaacaatacgaagaggagcttggcggcggaggaggcgtctga

SEQ ID NO: 6 - protein, 5104 aa, Periplaneta americana
MADSEGSSEQDDVSFLRTEDMVCLSCTATGERVCLAAEGFGNRHCYLENIADKNIPPDLSQCVFVIEQALSVRALQELVTATSSQEGKGGTGSGHRTLLYGNAILLRHQNSDMYLACLSTSSSNDKLSFDVGLQEHSQGEACWWTVHPASKQRSEGEKVRVGDDLILVSVATERYLHTAKENELSVVNASFHVTHWSVQPYGTGISRMKYVGYVFGGDVLRFFHGGDECLTIPSTWSNVSGQNIVIYEGGSVMSQARSLWRLELARTKWAGGFINWYHPMRIRHLTTGRYLGVNENNELHLVCREEATTASSTFFLRQEKDDQKIILEDKDLEVIGAPIIKYGDSTVLVQHSDTGLWLTYKSYETKKKGVGKVEEKQAVLHEEGKMDDGLDFSRSQEEESRTARVIRKCSSLFTQFISGLENLQSNRRSSLFCSFVNLNEMVMCLEDLINYFAQPEEDMEHEEKQNRFRALRNRQDLFQEEGILNLILEAIDKVNIITSQGFMVSLAGDESGQSWDVISGYLYQLLAAIIKGNHTNCAQFANTNRLNWLFSRLGSQASSEGTGMLDVLHCVLIDSPEALNMMKDEHIKVIISLLEKHGRDPKVLDVLCSLCVGNGVAVRSSQNNICDFLLPGKNLLLQTLLVDHVASVRPNIFVGHVSGSAVYRKWYYEVAIDHVEQTTHLNPHIRIGWANTAGYVPYPGGGEKWGGNGVGDDLYSFGFDGSYLWTGGRKSEVMPGSEISNIKKGDVIGCALDLTIPIITFTLNGQLVQGAFRDFNLDGMFFPVISCSSKVGCRFLLGGDHGRLKFTPPDEFSPLFESLLPQQILTIDPCFYFGNLSKCVLTGPWYVEDDTAFVPNPVDTSMVTLPSYIENIKDKLAENIHEMWAMNKIEAGWQYGDKRNDTRKYHPCLIQFDKLPPAEKRYDSQLAVQTLKTVIALGYHISIDNPPSRIKTVRLPNEPFMQSNGYKPAPLDLSAINLSGKMEELIDQLAENTHNLWAKERIQQGWTYGLNEELQMLRSPHLVPYSKVDDAIKKANRDTASETVRTLLVYGYNLDPPTGETNEATLLTDENTNRYLTFRTYRAEKTYAVASGKWYFEFEILTNGPMRVGWARFTCSPGYQIGSDENSWAFDGYNEEKIYMGTAESFGRQWQVGDVVGVFLDLMDHTISFSLNGELLMDTLGGETTFSEVQGEGFVPAFTLGLGQKAKLTFGQDVNSLKYFTTCGLQEGYEPFCVNMKRPVTYWYTKDQPIFENTDDFSSVIDVTRIPAGSDTPPCLKISHNTFETMERANWEFLRLSLPVICLPNFIDEQEKQRRWQEIRIRQHRLLSQSEHATPAHIEQIMKSGFSMSDIKGLHRGYSDDPVENDEMMPNTAPLPPRGKNQPPPPRPPRKGSLSRHDDLTIENDGKLNRSSSELNFNIYNQQNGNGQDINKDDKKKRGRSPFRFFSRKKEGPSDNPKRAKTPDPARNVVRSRNAAHRPNTLNERITPQIRVSQMDLKLVPPAIPDRPGGPKAMSFTPSSAGIEFVGNEIFDLECLKLINEYYYGVRIFPGQDPTHVYVGWVTTQFHLHSKDFSQNHVRKSTVTIVDEHNRILESIDRQSCYMVRSDELYNEVTNDSSGKGASQGMAIGCFIDIATGVMSFTCEGKETSFKFKMEPDIKLFPAIFVEASSKEILQIELGRTSTTLPLSAAVLQNSERHVLPQFPPRLKVQCLRPHQWARVPNDSLHIHTLKLSDIRGWSILCEDPVSMIALHIPEEDRCIDILELIEMEKLLSFHAHTLTLYAAVCYQANYRAAHILCTHVNQKQLLYAICSEYMSGPLRQGFYDLLIALHLESHATTMEVCKNEYIIPLGHELTALYDDPQMGHSLRSLQTESVRPQMKMTEISDVIDNVRNLYSPYFPLQVVREYVMAALEEAVLVNQVHNRDPIGGSNENLFLPLLKLVDRLLLVGMLRDEDVEKLLIMINPETWDPEFQKDGPDEHRKGLLHMKMAEGAKLQMCYLLHHLCDIQLRHRVESIISFSYQFVNDIQIDQLRRYNEIKQSDLPSAVAAKKTREFRCPPREQMNAILGFKNLDSDDKENCLIGDELRERMNEFNEKLMKQILLVALQESEDDKLDLNNINREGKIKQFYNFINAVKDEANENGLNEHEKKIPEEIFRKVLITTIVSWAEETQIETPKLVREMFSLLVRQYDSVGELIRALEKTYVINFKTKEDVAQMWVGLSQIRSLLPVQMSQEEEELMRERLWKLVNNHTFFQHPDLIRVLRMHENVMAVMMNTLGRRAQAQSQPGGTTVTGQDGEIVPKEKDTSHEMVVACCRFLCYFCRTSRQNQKAMFDHFSFLLENSNILLSRPSLRGSTPLDVAYSSLMENTELALALREHYLEKIAIYLSRCGLQSNSELIEKGYPDLGWDPVEGERYLDFLRFCVWVNGESVEENANLVIRLLIRRPECLGPALRGEGEGLLRAIIDANKMSERIAERRKFLEESGNQENIQLDHPLPESEDDEDYIDTGAAILNFYCTLVDLLGRCAPDSSVIALGKNESLRARAILRSLVPLEDLHGVLSLRFTLQNPAAGQDRPKSDMPSGLIPGHKQSVVLFLERVYGIEMQELFFTLLEEAFLPDLRTATMLDRNDGLESDMALAMNRYIGNSVLPLLIGHSKFYSESDNYANLLDATLHTVYRLSKNRMLTKGQREAVSDFLVALTSQMQPSMLLKLLRKLTVDVSNLSEYTTVALRLLTLHYDRCAKYYGSTGGQGIYGASSDEEKRLTMMLFSNIFDSLSKMDYDPELFGKALPCLSAIGCALPPDYSLSKNYDDEWYGSKQNIQGPSDGPYNPQPINTNSIVLDNDLNSIVHKFSEHYHDAWANRKLENGWVYGEQFNDVNKSHPRLKPYMMLSEYEKELYKEPVRESLKALLAIGWSIEHSENDAPLNNRGSVRRQSKSNENVTPFDYHPNPIDMTNLTLTREMQNMAERLAENSHDIWAKKKKEEVMLCGGGIHNQLVPYDLLTDKEKKKDRERSQEFLKYLQYQGYKLHRPNRNGGPSDAEQLAAASTGELRFSYSLLEKLIHYIDRASINMTLLKPSGTFSRRSSFKICTRDIKFFSKVVLPLVEKYFSTHRNYFITVATASSVLGAASLKEKEMVASLFCKLANLLRSKLMAFGADVRITVRCLQVLVKAIDAKSLVKNCPEFIRTSMLTFFHNIADDLEHTIQNLHDSRYCYLRGTHLKTSTSLFYVNDVILPVLSSLFDHLAAYEYGNELLLNEIQVAAYKMLSSLYTLGTDTSLTHDRKYLKVQLERHRPAFGSCLGAFSSTFPVAFLEPHLNKHNQYSLLNRFADSSLEAQDIMSRMEGTMPTLETVLNEVDQFVESEKTYADAPHIIDVILPLLCSYLPYWWAQGPDNVALTTGNHVTMVTSEHMNCLLKNVLKLIKKNIGNDNAPWMTQIAAYTQQIIINSSEELLKDPFLPLAERVKKRTETLYHKEESLRGFIKSSTDDTSQIEAQIQEDWQLVVRDIYAFYPLLIKYVDPQRNHWLRNNISNAEDLYNHVSEIFNIWSKSQYFLREEQNFISANEIDNMILIMPTATRRSAVISETSLGGSSGKKKKKHRDKKRDKEKEIQASLMVACLKRLLPVGLNLFAGREQELVQHCKDRFLKKMPDYDVIQFVKIQLTLPDKLDPADEMSWQHYLYSKLGSKKGNTEIKPQQVDEVADRIVAMAKVLYGLHMIDHPQLQSKATYRSVVSTQRKRAVIACFRQLSLHALTRHRAVNIFVRSFYELWLQDENIGQEVMIEDLTQSFEEAELKKRDKEEEEGMADPLNQMVTTFCRGAMTERSGALQEDPLYMSYADILAKSCGEEEEEGNNEEEGSNGNGDEEGGASIHEQEMEKQKLLFHQARLANRGVAEMVLLHISACKGIPSEMVMKTLQLGIAVLRGGNLDIQMGMLNHLKEKKDVGFFTSVAGLMNSCSVLDLDAFERNTKAEGLGVGSEGAAGEKNMHDAEFTCTLFRFIQLTCEGHNLEWQNCLRTQAGNTTTVNVAICTVDYLLRLQESIMDFYWHYSSKELIDPAGKANFFKAIGVASQVFNTLSEVIQGPCTQNQQALAHSRLWDAVGGFLFLFSHMQDKLSKHSSQVDLLKELLNLQKDMITMMLSMLEGNVVNGTIGKQMVDTLVESASNVELILKYFDMFLKLKDLTSSTSFTEIDPNNDGWVHPKDFKEKMEQQKSYTAEEIEFMLQCCESNHDGKIDYIGFTDQFHEPSKEIGFNLAVLLTNLSEHMPNEPRLTRFLETASSVLNYFQPFLGRIEILGGSKRIERVYFEIKESNIEQWLKPQIRESKRAFFYSIVTEGGDKEKLEAFVNFCEDAIFEMQHASGLMAVDDGSGIGGGKSRKTAYIYLADDEENKTAKDPIRRGIQAIKYGFQLLFFVLSPTNIKNKINEIQQMSFVELITSFFKLWFYLIFYTGYSGVYVLRYISRILMQLMSGTQSEETTVEVVEKRAGSFRMLPALPSSGVDEPPSTLIDSSNMRKNSGAPDSKHVKSTTVGDDKDETSTENHEKEDGVKSEDNSELQASFVDLLVGESARKDSIAGPEVLAQQQAVMAAVEAEIKQKNSVENPSAFSTIDINAYTHRALSFLARNFYNLKYVALVLAFCINFILLFYKVTTLAEDLSDDGDSKDFALGSAGISNDDIDDSNSTEIADDDGALELVHVNEDFFYMAHVMRLAALLHSLASLAMLIAYYHLKVPLAIFKREKEIARRLEFDGLYIVEQPEDDDIKSHWDKLVISAKSFPVNYWDKFAKKKVRQKYSETYDFDSISNLLGMEKTSFSTQENEERTGLINFVINIDWRYQVWKAGVTITDNAFLYSLWYFTFSILGNFNNFFFAAHLLDVAVGFKTLRTILQSVTHNGKQLVLTVLLLTIIVYIYTVIAFNFFRKFYIREEDDEVDKKCHDMLTCFVFHLYKGVRAGGGIGDEIGSPDGDDYEVYRIMFDITFFFFVIIILLAIIQGLIIDAFGELRDQLESVKEDMESNCFICGIGKDYFDKVPHGFDTHVQEEHNLANYMFFLMHLINKPDTEYTGQETYVWNMYQQRCWDFFPVGDCFRKQYEEELGGGGGV

SEQ ID NO: 7 - DNA, 15413 bp, Peregrinus maidis
  misc_feature (1264): n = a,c,g, or t
  CDS (17)..(15397)
ggatccttaattaacaatggcggatagtgagggtggatctgagcaggatgatgtttcgttccttagaacggaagacatggtttgtctgtcatgtacagccaccggtgaaagagtttgcctcgctgcagaaggatttggtaaccgtcattgtttcctggaaaacatcgctgacaagaatattccaccagatttgtccacatgtgtatttgttattgagcaagctttatcggttcgagctcttcaggaattggttactgctgctggatcagaagagggtaaaggaactggatcaggacataggaccctattgtacggcaatgctattctacttcggcatcaaaacagtgatatgtacttggcctgctcgtcaaccagctcatccaatgataaactgtcattcgatgttggtctccaagaacattcacaaggtgaggcctgttggtggactgtgcatcctgcttccaagcaaagatcggagggtgagaaggtgcgagttggtgacgacttgatcttagtttcagttgcaactgaacgatacttgcatacaacaaaagagaacgatttgtccatcgtgaatgcttcctttcatgtaactcattggtccgttcagccttatggcacaggaataagtcgcatgaaatatgttggttatgtgtttggtggcgatgtgcttcggttctttcatggtggtgatgagtgccttacaattccatcaacgtggagtgaagcacctggacagaatattgtggtttatgagggaggcagtgtcatgagtcaagctcgttcattatggagactagaacttgctagaacaaaatgggcaggtggtttcataaattggtaccacccaatgagaatacgacacttgacaactggtcgataccttggtgtcaacgagaacaatgaactacatctgattgtgagagatgaggcaacgacggcgttgtcagcattctgtctgcgacaagagaaagatgatcagaaagtggtgcttgaagacaaagacctagaagtaataggtgcaccaattatcaagtatggtgacagtactgttctggttcagcattctgagactggcttgtggcttacatacaaatcatatgaaactaaaaagaaaggagttggaaaagttgaagagaaacaagctgtgctccatgaggaaggaaagatggacgacggcttggatttctcccgcagtcaagaagaagaatcgcgtaccgctcgtgtaattaggaagtgttcatccttgttcactcagtttatnagaggtctagagaccttgcaggtgaatagaaggcactcgttattttgtgcaactgtgaatttgaatgaaatggtaatgtgcctcgaagatttgattaactattttgcgcagccagcagatgatatggaacacgaagaaaaacaaaataggttccgtgcattgagaaatcgtcaagatctgtttcaagaagaaggcatattaaatttaattctggaagccatcgataaaataaatgtgataacgtctcaaggattccttgtaagtttagcaggagatgaatcaggacaaagctgggatataatttctggttacctgtatcaacttcttgctgctataattaaaggaaatcatacaaattgcgctcagtttgcgaattcaaatcgtctgaattggctgttcagcagactgggctcacaagcatcaagtgaaggcacgggaatgcttgatgtattgcattgtgttctcattgattcgcctgaagcgttgaatatgatgagggatgagcatataaaagttataatatctcttcttgagaaacatggaagggatccgaaagttttggatgttctctgttcactgtgtgtgggtaatggtgttgctgttcgtagctcacaaaacaatatttgtgatttccttctacctggaaaaaatcttcttcctcaaacgcaactagtggatcatgtggctagtgtccgtccaaatatatttgttgggcgtgttgttggctctgcagtttatcaaaaatggtattttgaggttaccatggatcacattgagcagacaacacacatgacacctcacttgagaattggctgggcgaacactagtggatatgtgccttatcctggaggaggtgaaaagtggggtggaaatggagttggtgatgatctttattcttatgggttcgatggcgcgaatttatggacaggaggacgtaaaacttgtgttctaccgcatgcgactgagccattcatcaagaaaggcgatgtaattggagtgtctctagatttaactgtgccaatcataacattttcattcaatggttcgcctattaggggctgcttcagagatttcaactatgatggaatgttctttcctgttataagttgctcgcacaagctaagttgccgatttcttttaggtggagaccatggtcgactgaaatatgttccaccagaagaattctctccacttgttgaaagtctgcttcctcaacaagtgttgtccattgatccatgtttctactttggtaatttgaacaaatgtgtattatcaggcccatggacagttgaggatgatacagcatttgttccaacacctgttgatacaacaaaggtttcgctcccaaattatattgagagcataagagataagttggcagaaaatattcatgaaatgtgggctatgaacaagatagaagctggctggatgtttggggagaagcgagatgacatacgtaaagtgcatccatgccttattcagttcgaccaacttccaccagctgagaagcgctatgactcacaactcgcagttcaaactctcaagacaattctggcactcggctactacataacgatggataagcctccttcgcgtataaaaacaattcgtcttccaaatgagcctttcatgcaatcaaatggctacaagccagcaccacttgatctcacggccatatcattaacaccgaaaatggaggaattagttgatcaactagccgagaatacacataatctatgggccaaagaacgaatccaacaagggtggacgtatggactcaatgaggactctgatatgttgagaagtccgcatctggtgccttactgcaaagttgacgaagctataaaaaaagctaacagggatactgcaagtgaaacggtcagaactctattggtgtatggctacaatctagatccccccaccggcgaagcacatgaagctcttcttgcagaggctagtcgtttaagacagactcacttcagaacgtaccgagcagaaaagaactatgccgtgacaacgggaaagtggtattttgaatttgaaatccttactgctggaccaatgagagtaggttgggcacggtcagattgtccgccaggatcacaattgggaaatgacgaatattcgtgggcatttgatggcttcaacgaggaaaaagtgtacttgggaacaggcgagtcgtttggtcgccagtggcaggttggagatgtggttggagtatttcttgatctattggaccataccatgagtttctctttgaatggagaactgcttatggatgcccttggaggggagacttcattcgctgacgttcaaggggaaagctttgttcctgctttcacccttggcgtaggccagaaagctaaactgacttttgggcaagatgttactgtattaaagttttttacaacttgcggtcttcaagaaggatatgaaccattytgtgtcaatatgaacagagcggtaacgtattggtacaccaaggaccacccaatttttgagaatactgaagattatgccgactcacgaattgatgttacaagaattccagctggttcggatactccaccttgcctcaaaataagtcacaacctattcgagtcaatggaaaaagccaattgggaattcctcagactctcactcccagttatttgccactcatcatttatcgaagagagtgaaaaattgaaacgttggcaggagataagaatccgtcagcatagactgttagtcgaggctgaccaaacaacaccagcccatatggaacaaatcatgaaatctggcctctccatgagtgacattaaaggactccatagaggctactcagaagatgcagtggaggcagatgaaatgatgatgcaaagtacaccaacaacaaagagtaaaatgagacagccatcaagacctcccaggaaaggatcactttccagaaatgaggatatgccaatgattaatggatctttagaacaaagtaaaatgaacagatcaaccagtgagctggatcttaataggtataatgctgatttgcaaaatgataaggacgacaagaagaagaggggtcgatctcctttcaggttcttctctcgcaaacgtgaagctagcaatgaaagatcgaagaaggctaaaagtccagagcccaactctatgatggaagctgacagagggcaaatgggtagatctcagcatcatatgatgaggacacccactgtcaaagtaacagctccggatatgaaagtcattcctccaaccatacctgaacgttccaacatgcctaagcaaatgactggagcgcctctttctggcagtggaattgaatcggttggcaacgaaatattcgatggcgaatgtctcaagttgatcaatgaatatttctacggtgtgcgtattttccccggtcaggatccaactcatgtgtatgtcggttgggtgacaacccagtaccactttttcgccaatgagttcaatcagtcgaaagtaagaaaagtcacagtgcatacccttgatgaattcagtcgagtcaatgagagtgtcgatagacaaagctgttacatggtacgatccgatgagcttttcaatgaagttacaaacgactcttctggaaaaggtgcttcgcagggaatgttcattggctgctttgtggatgccgcaaccggttacatatctttcacttgtgaagggaaggagacaagtcacaagttcaagatggaaccagaaacaaagttattcccagctatatttgtggaagcaacgagtaaagaaatcctgcaaattgaactgggacgaacttcaacaaccttacccctttcagctgcagttttgcagaattctgaacgtcacgtcaatccacagtttccacctcgcttgaaagtgcaatgtttgaaaccgcaccaatgggctagagttccaaatgtatctcttcaagttcatgctttgaagttgtctgatattcgtggttggagtatgttgtgtgaagatccaatgtcaatgttagctcttcacatcccagaagaagatcgcagcattgatattttggaattaattgagatggaaaagttgttatcgttccatgcacacactctaactctctatgcagctctttgctttcagtccaactatcgggctgctcacacactctgctcgcatgttgatgagaaacaacttttgtacgcaattcgctcagactacatgtcagggcctttgagacaaggcttttatgaccttcttattgctcttcatctggaatcgcatgcctacacgatggaagtgtgcaaaaatgaatttattataccaataggtcaagaactgaaagatgtctatgaagatccagaaatgtgtcacagtcttagatcattaaaaaccgagtcagtgctacccacaatgaagatgacagataaagctgatgaaccttctcccagtgaagtcgtggacaatatcaggagcttgtacagtcctcagtttcctttggatgtggtcagagattttgttatggctgcactcgatgaagctgttcaaatcaaccaactccataatagagatccggtgggaggctctaatgaaaactacttcctgccactgttgaagttagttgaccgcttgttactagtcgggatgcttcgagatggagatgtcatgaagctgctgataatgttcagtccagaaacttgggacacggcatttgaaaaagatggcaaagatgaacaccggaagggtttgctgactatgaagatggctgaaggtgctaaattgcagatgtgctacctattgcatcatctttacgatatccaacttcgtcacagagtggaagctattatctcttttagtgtcgatttcgtcggagatttgcaatcagatcaactcagaagatatatcgagatcaaacaatcagacttaccatctgccatcgcagctaaaaagaccagggagttccgatgtccacccagagaacagatgaatgctattctcggattcaaaaacttggaagaaggtgatatagagaactgcccatgtggagatgaacttagagagcggttgaattctttccatgagaaattaatgcataaagtatctctactggcactgcaagagccatctgaagaggaagcgtccgcagaagaagtgaaaaaacctaatgcccttaaccgtctttataacttcataaatgcggtcaaagagcttgaagaaactcctcagatagaagaagagcctgagaaaaaaactccagaagaaatcttcaggaaggttctgatcagcacaattgtcaaatgggctgaagagactcaaattgaatcaccaaaacttgtgagagagatgttcagtttgttggtacgtcagtatgatactgttggcgaactgatccgtgctctgggaaagacgtatgtgattaacagcaaaactaaggatgatgctgccttgatgtgggttggactgagtcagatacgtgccttattgcctgtgcaaatgtctcaagaggaagaaggtcttatgcgcgagcgtttatggaaattggtcaacaatcatactttcttccagcaccccgatttgataagagtgctgcgtgtgcatgaaaacgtgatggcagtgatgatgaacactcttggtaggcgggcccaagcccagtcagacgctcctcaagctggtcaggaaggagagccagtggccaaagaaaaagatacttctcacgagatggttgtggcttgctgtcggttcctgtgctacttctgtagaacatccagacagaatcagaaagctatgttcgatcacttcgcatttctcctggaaaacagtaatattttactatcacggccttctttgagagggagcactcctcttgatgttgcttattcatcactcatggagaacaccgagctcgctcttgcgctcagagaacactacttggagaaaattgctatatacttgtcccgatgtggactgcaatccaattctgagttgattgaaaagggctatcctgatctgggatgggaccccgtggaaggcgaaagataccttgattttctacgtttctgcgtctgggttaatggtgagagtgttgaagaaaatgccaatcttgttatcaggctgctgattaggaggcctggatgtcttggtccagcattaagaggagaaggagagggtttactgagagcgattgttgatgccaacaagatgtcagaaagaattgctgatcgaagaaaagtgatggatgagccagaaggtacaacaatggttatgcatttcgaacaccctcttccggaatcagatgatgatgaggattatattgatactggggctgcaatccttgcattctattgtactctggtagatttacttggtcgttgtgctcctgattcttctgtcattgcccaaggtaaaaatgaatcattgagagctcgagccatcttgcgatctctagtacctctagaggatctccagggtgttctaagtctcaaattcactttgcaaaatcctgcagcgggtgaggaacgtcctaagagtgatatgccctccggcttgattcctggtcacaaacaaagtgtcgttctcttcttggagagagtctatggcattgaaacacaagaactgttttttagactactagaggaggcatttctacctgacctcagagcagctactatgcttgacaggaatgacggctctgaatcagatatggcattagctatgaaccgctacattggcaattccatcctgcctttgttgattactcattcaaaattctacaacgaagcggataattatgccagcttgttggatgctacgttgcacactgtataccggttatcaaagaatagaatgctcaccaaaggacaacgagaagcggtttcagactttcttgtagctctgacgtcttccatgcagccgagtatgctgttgaaattgctaagaaaattgactgttgacgtttcaaaactaactgaatacacaacagttgctctgcgattgctcactcttcattatgatcgctgcgccaaatattatggatcgactggtggacagggtctatatggatcgtcaagcgatgaggaaaagcgcctaaccatgatgcttttcagcaatatattcgattccctctcgaaaatggattatgatcctgaactgtttggtaaagctctgccgtgcttgacagctattggctgtgctctgccacccgattattctctctcgaagaattatgatgatgaactgtacggtgcaagagattcacaagctggtccatctgatggcccttataatcctcagcctataaatactcatagtgttgtcctcaacaatgacttgaacacaatagttcaaaaattctccgaacattatcatgatgcatgggcgagcaggaagctagagaatggatggacttacggtgatcagtggagtgactcacaaaaaactcacccaaggctaaagccatacaatatgctcaacgactatgttgaaccctcaatcgaaagagaacgttacaaagagcctgtcagagagtcaataaaggctttgttggcaattggatggactgtggagcacagtgaagcagatgttccactcactagtcgaggatcaattcggcgacagtccaagccaaatgcaatggtcgactcttccactcctttcaactatcatccaaatcctattgatatgacaaacctgacattgggcagagagatgcaaaatatggctgagcgtttagctgaaaatgctcatgacatttgggctaagaagaaaaaagaggaactcataacttgtggtggaggaatccatccgcaactcgtgccgtatgacttgttgactgataaggaaaagaagaaggacagagagcgatctcaagaattcttgaaatatctgcaatatcaaggctataagttgcacaggcctagtcgcacagggggtccatccgagtcggaacaattggcagcccaagcaactggtgagcttagatttgcgtacagcctgctcgagaagctcatccagtacattgacagagcctctatcaacatgaagcttctcaaaccttcgacgacattcagccgccgctcaagctttaaaacttgcacaagggacattaaatttttctcaaaagtcgttctaccacttgtggagaaatatttcagcacacataggaattactttattgctgtagcgaccgcatcgaataatattggagcagcatcgttgaaagaaaaagaaatggtagctagtctattctgcaaacttgcaaacttgctaagatctcgattggctgcttttggtgctgatgttcgaatttctgtgaaatgtttacaagtgctcgtaaaaggaattgatgcaaaatcgctggtaaagaattgtccagaatttatcagaacatcgatgctaacgtttttcaataatacagctgatgacttgggacacacaattcaaaacttacaagagggcaaatacagtcatctgcgtggagcacatctgaaaacgtctacctcgctattctacatcaatgacgtcatccttccagttttaacggccatgttcgatcacttagctgcatgcgaatatggcagtgacttggtattggatgaaatacaagtggcgtcatataaaatgcttggtagcttgtacacattaggaattgatgtcactctcactcatgacaggaaatacttgaagactgaaatcgacagacatcgaccgcaacttggaagatgtcttggagcctatgcatcaacttttccagtagcatttttggagccgcatttgaacaaacacaaccaattctccttagtcaatcgtatagctgaccattctttagaagctcaagatattctttctcgaatggaaagtacaatgccaactttagacaacattttgagtgaagttgatcagtttgtagagtcggataaaacccataacgatgcacctcatattattgatgtgataatgccaatgctatgctcctatttgcctgtttggtggaatcaaggacctgataatgttgctctcactgccggaaattatgtcacaacggtgacgagtgaacatatgaatcaacttttaaagaatgtactcaaaatgattaagaaaaatattggaaatgaaagcgctccatggatgactaggatagcagcatatacacaacaaataataatcaactcttcggaggagttgttgaaagatccattcctcccattggctgaaagagtgaagaaacggactgatgctatgtttcataaagaggaatcactcaggggattcataaaatcggcctctgatgacacttctcagattgaagcgcaaattcaagaagattggcaacttcttgtgagagatatctactcattctatccacttctcatcaagtacgttgacttgcaaaggaatcattggttgagaaataatatttctgaagctgaagacttgtataatcatgtagcagaaatcttcaatacttggtcgaagtctcaatatttcctcaaagaagaacagaacttcatttcggcgaatgaaattgataatatggttctcatcatgcccacggctactaggagaagtgccgtagtcagtgacagtgctgctccccctggaggcagcggtaagaaaaagaagaagaacagagagaagaagagggacaaggacaaagagcttcaagccagtctaatggttgcttgcttgaagaggctgcttcctgttggtttgaatctctttgctggacgagaacaagaactggttcagcattgcaaagacagattcctgaagaaaatgcaagactatgaaatagtggaatttgctaagattcaattgacccttcctgacaaactagatccaggtgatgagatgtcgtggcagcactatctgtattccactctgggcagtaagaaagagatcaccgaaggaggcaaacctgaacagatcgatgcggtcgttgacaggattgttgccatggctaaagttctgttcggtctgcatatgattgaccaccctcagctgcaaagcaaggccagttatcggtcggttgtttcaacccaacgtaaacgagcagtcattgcttgtttcagacagctatcactacacgctttaccaaggcataaagctatcaacatatttgctagatcgtattacgagctgtggctgactgaagagaatgttggaaccgaggttttgattgaagacctcacgcaatcatttgaagatgctgaactcaagaaaacagatgaagaagtagatgaagggaagtcagatccgctgacacagcttgtgacaacattctgcagaggagcaatgactgagcgaagcggcgccctccaggaagaccctctctacatgtcctatgctgagatcgctgccaagtcttgtggcgaagaggaagaagaaggtggtgatgaagaggaaggaggagaaggagaagaacagggtgcctcaatacacgaacaagaaatggaaaagcagaagctgctcttccatcaatcaagactggctaatagaggcgtggcagagatggtgttattgcacatttccgcttgcaatggtgttccaagtgatatggtggagaaaacgcttcaacttggtatatcgattcttcgaggtggcaacattgatatccaaatgggaatgctgaatcacctaaaagaaaagaaagatgtgggattttttacatctatcgctggattaatgaattcctgcagtgtactggatttggacgcatttgagcgcaatacgaaggcagagggcttgggcgtgggatcggatggcgcagctggtgagaagaacatgcacgacgctgagttcacctgcacattgttcagattcattcaattgacatgtgaaggtcacaatcttgaatggcagaattatttgagaactcaagcaggaaacactacaaccgtgaacgttgtcatatgtaccgtagattatcttctgagactacaggaatcaatcatggacttttattggcattattcgagcaaagaattgattgacccagcaggaaaagccaatttttttaaagctataggagttgctagtcaggttttcaacacattgtctgaggttattcaaggtgcttgtactcagaaccagcaagctttggctcattccaaattgtgggacgctgtcggtggtttcctatttttattctctcatatgcaagataagctatcaaagcattcaagtcaagtcgaccttctcaaggaactgctaaatctacagaaagacatgatcaccatgatgttatctatgcttgaaggaaatgttgtaaatggtactattggaaaacagatggttgatactttggttgaatctgcttcaaatgttgagttgattctgaaatattttgatatgttcctgaaactaaaagacatgactgaagcacctagcttcttggaaatcgatccgaatcacgatggttgggttctacccaaagatttcaaagagaaaatggaacaacaaaagagctatacaacagaagaaattagcttcatgctgcagtgttgtgaaactaatcacgatggaaaggttgattacattggcttcgttgacagattccatgaaccttccaaagaaatcggtttcaacttggctgtattattaacaaacctatctgagcacatgccgaatgagcccaggttggctagatttttggaaactgcaggcagtgtactaaattactttgaaccattcctaggacgtattgaaattatgggcagcagtaaacgtatagaaagagtgtattttgaaatcaaggagtcaaatattgaacagtgggagaaacctcaaattaaagagtccaagagagcattcttctactcaatcgtgactgaaggtggtgataaagaaaagctggaggcatttgtaaatttctgtgaggatgcaatttttgaaatgactcatgccagtggtttaatgtcagtcgatgatgactcaggcggcggtggaggcaaagctgcttacacatacatctccgaagaagacgaagaaaagaatgcaaaagatcccatcaggagaacgattcaagctttcaaggatgcaatttatttcatactcactatgctgtctccgtcaaacatcaaaaccaaaataaatgaaatgcagcagatgagtgtaccggagctagttgttggctttttcaaaatattcttttacatgttctactattcaggatttagtgtatcagttgttcttagatattttggaaggatattgatgacattaatgaggggaccacaaactgaagaaccagttgcggaagttaaaaaggaagatgagataatgggaccgattagagctctaccgccccctccacccgataataaagaagcatcatcttcctctgccaaagatgacagtggccaagccaagcctgccgatggaggtgctacattagcattaactgccagtggggaagaacataaagaaggtggagcaactgaggaaggagccgaagatggagcgaagccagaaggtgccgaaaccactgaaggaactaccatgaccctggctgatctcttaggaggagaagcagctcgcaaagaagcagtagctagagctgaagtagctgctgaacaacaagctgtcatggctgctgttgaggctgaagcaaagcatgaagttgtgtcggaaccatccgcgttctcacagattgacttcaatagatatacacatcgtgctgtaagttttcttgctaggaatttctacaacttgaagtatgtcgcgctggttcttgctttttgcataaatttcatcctgctcttctataaggttacaactctgggtgaagatgaagatgacggtggcagtggtgagctgggaggtggattggctgaagatctattggaggagctgggaggggggtcaggagaagagggtggaggactgagtggaggtataagtggaggcgagagtggcgaagacggaagtggcgaggaggaggatcctatagagctggtgcacgtgaacgaggacttcttctacatggctcatgttatgaagatcgctgctatgctgcattctcttgtatctctagccatgctcatcgcctactatcatctcaaggtaccactagctatattcaaacgagaaaaggaaatagcacgacgattggagtttgatggattatacatagccgaacaacctgaagatgatgacataaaatcacactgggataaattggtcatatcagctaaatcatttcctgtcaattactgggacaaatttgtaaagaagaaggtcaggcaaaagtatagcgaaacttatgatttcgattcaataagcactctactggggatggaaaaaacatcattcagctcccaagaaactgaagaaggaactggaattatcaacttcatattgaatatagattggcgatatcaagtttggaaagctggcgtcactataaccgacaatgcgttcttatacagtttatggtatttcatattctcaattcttggcaattttaataatttcttcttcgctgctcatttgctggatgttgctgttggattcaaaacattgagaacgatcttacagtctgtcacgcacaatggaaaacagttggttttgacagtcatgctcctcacaatcattgtgtatatttacacagtaatcgccttcaacttcttccgtaaattctatgtccaagaagaagatgaagaagttgataaaaagtgtcatgatatgttaacatgttttgtattccacttatacaaaggagtaagagctggtagtggaattggagatgaaatcgaaccacctgatggcgatgattacgaagtgtaccgtatcatgtttgacattactttcttcttctttgtcattgttattctgctggctatcatccagggtttgattattgacgcttttggtgagctgagagatcagttggagagcgtaaaggaagacatggagtccaactgtttcatttgtggcattggtaaagactactttgataaagtgccgcatggtttcgatactcatgtgcagcaagagcataatctcgctaattacatgttcttcctcatgcatctaattaataagccagatacagagtatactggtcaagagacgtatgtgtggaatatgtaccaacaaaggtgttgggacttctttccagttggtgactgtttccgtaagcaatatgaagatgagttaggaggcggtggtggctgagtaaagggcgaat

SEQ ID NO: 8 - protein, 5127 aa, Peregrinus maidis
  misc_feature (416)..(416): Xaa = Ile
MADSEGGSEQDDVSFLRTEDMVCLSCTATGERVCLAAEGFGNRHCFLENIADKNIPPDLSTCVFVIEQALSVRALQELVTAAGSEEGKGTGSGHRTLLYGNAILLRHQNSDMYLACSSTSSSNDKLSFDVGLQEHSQGEACWWTVHPASKQRSEGEKVRVGDDLILVSVATERYLHTTKENDLSIVNASFHVTHWSVQPYGTGISRMKYVGYVFGGDVLRFFHGGDECLTIPSTWSEAPGQNIVVYEGGSVMSQARSLWRLELARTKWAGGFINWYHPMRIRHLTTGRYLGVNENNELHLIVRDEATTALSAFCLRQEKDDQKVVLEDKDLEVIGAPIIKYGDSTVLVQHSETGLWLTYKSYETKKKGVGKVEEKQAVLHEEGKMDDGLDFSRSQEEESRTARVIRKCSSLFTQFXRGLETLQVNRRHSLFCATVNLNEMVMCLEDLINYFAQPADDMEHEEKQNRFRALRNRQDLFQEEGILNLILEAIDKINVITSQGFLVSLAGDESGQSWDIISGYLYQLLAAIIKGNHTNCAQFANSNRLNWLFSRLGSQASSEGTGMLDVLHCVLIDSPEALNMMRDEHIKVIISLLEKHGRDPKVLDVLCSLCVGNGVAVRSSQNNICDFLLPGKNLLPQTQLVDHVASVRPNIFVGRVVGSAVYQKWYFEVTMDHIEQTTHMTPHLRIGWANTSGYVPYPGGGEKWGGNGVGDDLYSYGFDGANLWTGGRKTCVLPHATEPFIKKGDVIGVSLDLTVPIITFSFNGSPIRGCFRDFNYDGMFFPVISCSHKLSCRFLLGGDHGRLKYVPPEEFSPLVESLLPQQVLSIDPCFYFGNLNKCVLSGPWTVEDDTAFVPTPVDTTKVSLPNYIESIRDKLAENIHEMWAMNKIEAGWMFGEKRDDIRKVHPCLIQFDQLPPAEKRYDSQLAVQTLKTILALGYYITMDKPPSRIKTIRLPNEPFMQSNGYKPAPLDLTAISLTPKMEELVDQLAENTHNLWAKERIQQGWTYGLNEDSDMLRSPHLVPYCKVDEAIKKANRDTASETVRTLLVYGYNLDPPTGEAHEALLAEASRLRQTHFRTYRAEKNYAVTTGKWYFEFEILTAGPMRVGWARSDCPPGSQLGNDEYSWAFDGFNEEKVYLGTGESFGRQWQVGDVVGVFLDLLDHTMSFSLNGELLMDALGGETSFADVQGESFVPAFTLGVGQKAKLTFGQDVTVLKFFTTCGLQEGYEPFCVNMNRAVTYWYTKDHPIFENTEDYADSRIDVTRIPAGSDTPPCLKISHNLFESMEKANWEFLRLSLPVICHSSFIEESEKLKRWQEIRIRQHRLLVEADQTTPAHMEQIMKSGLSMSDIKGLHRGYSEDAVEADEMMMQSTPTTKSKMRQPSRPPRKGSLSRNEDMPMINGSLEQSKMNRSTSELDLNRYNADLQNDKDDKKKRGRSPFRFFSRKREASNERSKKAKSPEPNSMMEADRGQMGRSQHHMMRTPTVKVTAPDMKVIPPTIPERSNMPKQMTGAPLSGSGIESVGNEIFDGECLKLINEYFYGVRIFPGQDPTHVYVGWVTTQYHFFANEFNQSKVRKVTVHTLDEFSRVNESVDRQSCYMVRSDELFNEVTNDSSGKGASQGMFIGCFVDAATGYISFTCEGKETSHKFKMEPETKLFPAIFVEATSKEILQIELGRTSTTLPLSAAVLQNSERHVNPQFPPRLKVQCLKPHQWARVPNVSLQVHALKLSDIRGWSMLCEDPMSMLALHIPEEDRSIDILELIEMEKLLSFHAHTLTLYAALCFQSNYRAAHTLCSHVDEKQLLYAIRSDYMSGPLRQGFYDLLIALHLESHAYTMEVCKNEFIIPIGQELKDVYEDPEMCHSLRSLKTESVLPTMKMTDKADEPSPSEVVDNIRSLYSPQFPLDVVRDFVMAALDEAVQINQLHNRDPVGGSNENYFLPLLKLVDRLLLVGMLRDGDVMKLLIMFSPETWDTAFEKDGKDEHRKGLLTMKMAEGAKLQMCYLLHHLYDIQLRHRVEAIISFSVDFVGDLQSDQLRRYIEIKQSDLPSAIAAKKTREFRCPPREQMNAILGFKNLEEGDIENCPCGDELRERLNSFHEKLMHKVSLLALQEPSEEEASAEEVKKPNALNRLYNFINAVKELEETPQIEEEPEKKTPEEIFRKVLISTIVKWAEETQIESPKLVREMFSLLVRQYDTVGELIRALGKTYVINSKTKDDAALMWVGLSQIRALLPVQMSQEEEGLMRERLWKLVNNHTFFQHPDLIRVLRVHENVMAVMMNTLGRRAQAQSDAPQAGQEGEPVAKEKDTSHEMVVACCRFLCYFCRTSRQNQKAMFDHFAFLLENSNILLSRPSLRGSTPLDVAYSSLMENTELALALREHYLEKIAIYLSRCGLQSNSELIEKGYPDLGWDPVEGERYLDFLRFCVWVNGESVEENANLVIRLLIRRPGCLGPALRGEGEGLLRAIVDANKMSERIADRRKVMDEPEGTTMVMHFEHPLPESDDDEDYIDTGAAILAFYCTLVDLLGRCAPDSSVIAQGKNESLRARAILRSLVPLEDLQGVLSLKFTLQNPAAGEERPKSDMPSGLIPGHKQSVVLFLERVYGIETQELFFRLLEEAFLPDLRAATMLDRNDGSESDMALAMNRYIGNSILPLLITHSKFYNEADNYASLLDATLHTVYRLSKNRMLTKGQREAVSDFLVALTSSMQPSMLLKLLRKLTVDVSKLTEYTTVALRLLTLHYDRCAKYYGSTGGQGLYGSSSDEEKRLTMMLFSNIFDSLSKMDYDPELFGKALPCLTAIGCALPPDYSLSKNYDDELYGARDSQAGPSDGPYNPQPINTHSVVLNNDLNTIVQKFSEHYHDAWASRKLENGWTYGDQWSDSQKTHPRLKPYNMLNDYVEPSIERERYKEPVRESIKALLAIGWTVEHSEADVPLTSRGSIRRQSKPNAMVDSSTPFNYHPNPIDMTNLTLGREMQNMAERLAENAHDIWAKKKKEELITCGGGIHPQLVPYDLLTDKEKKKDRERSQEFLKYLQYQGYKLHRPSRTGGPSESEQLAAQATGELRFAYSLLEKLIQYIDRASINMKLLKPSTTFSRRSSFKTCTRDIKFFSKVVLPLVEKYFSTHRNYFIAVATASNNIGAASLKEKEMVASLFCKLANLLRSRLAAFGADVRISVKCLQVLVKGIDAKSLVKNCPEFIRTSMLTFFNNTADDLGHTIQNLQEGKYSHLRGAHLKTSTSLFYINDVILPVLTAMFDHLAACEYGSDLVLDEIQVASYKMLGSLYTLGIDVTLTHDRKYLKTEIDRHRPQLGRCLGAYASTFPVAFLEPHLNKHNQFSLVNRIADHSLEAQDILSRMESTMPTLDNILSEVDQFVESDKTHNDAPHIIDVIMPMLCSYLPVWWNQGPDNVALTAGNYVTTVTSEHMNQLLKNVLKMIKKNIGNESAPWMTRIAAYTQQIIINSSEELLKDPFLPLAERVKKRTDAMFHKEESLRGFIKSASDDTSQIEAQIQEDWQLLVRDIYSFYPLLIKYVDLQRNHWLRNNISEAEDLYNHVAEIFNTWSKSQYFLKEEQNFISANEIDNMVLIMPTATRRSAVVSDSAAPPGGSGKKKKKNREKKRDKDKELQASLMVACLKRLLPVGLNLFAGREQELVQHCKDRFLKKMQDYEIVEFAKIQLTLPDKLDPGDEMSWQHYLYSTLGSKKEITEGGKPEQIDAVVDRIVAMAKVLFGLHMIDHPQLQSKASYRSVVSTQRKRAVIACFRQLSLHALPRHKAINIFARSYYELWLTEENVGTEVLIEDLTQSFEDAELKKTDEEVDEGKSDPLTQLVTTFCRGAMTERSGALQEDPLYMSYAEIAAKSCGEEEEEGGDEEEGGEGEEQGASIHEQEMEKQKLLFHQSRLANRGVAEMVLLHISACNGVPSDMVEKTLQLGISILRGGNIDIQMGMLNHLKEKKDVGFFTSIAGLMNSCSVLDLDAFERNTKAEGLGVGSDGAAGEKNMHDAEFTCTLFRFIQLTCEGHNLEWQNYLRTQAGNTTTVNVVICTVDYLLRLQESIMDFYWHYSSKELIDPAGKANFFKAIGVASQVFNTLSEVIQGACTQNQQALAHSKLWDAVGGFLFLFSHMQDKLSKHSSQVDLLKELLNLQKDMITMMLSMLEGNVVNGTIGKQMVDTLVESASNVELILKYFDMFLKLKDMTEAPSFLEIDPNHDGWVLPKDFKEKMEQQKSYTTEEISFMLQCCETNHDGKVDYIGFVDRFHEPSKEIGFNLAVLLTNLSEHMPNEPRLARFLETAGSVLNYFEPFLGRIEIMGSSKRIERVYFEIKESNIEQWEKPQIKESKRAFFYSIVTEGGDKEKLEAFVNFCEDAIFEMTHASGLMSVDDDSGGGGGKAAYTYISEEDEEKNAKDPIRRTIQAFKDAIYFILTMLSPSNIKTKINEMQQMSVPELVVGFFKIFFYMFYYSGFSVSVVLRYFGRILMTLMRGPQTEEPVAEVKKEDEIMGPIRALPPPPPDNKEASSSSAKDDSGQAKPADGGATLALTASGEEHKEGGATEEGAEDGAKPEGAETTEGTTMTLADLLGGEAARKEAVARAEVAAEQQAVMAAVEAEAKHEVVSEPSAFSQIDFNRYTHRAVSFLARNFYNLKYVALVLAFCINFILLFYKVTTLGEDEDDGGSGELGGGLAEDLLEELGGGSGEEGGGLSGGISGGESGEDGSGEEEDPIELVHVNEDFFYMAHVMKIAAMLHSLVSLAMLIAYYHLKVPLAIFKREKEIARRLEFDGLYIAEQPEDDDIKSHWDKLVISAKSFPVNYWDKFVKKKVRQKYSETYDFDSISTLLGMEKTSFSSQETEEGTGIINFILNIDWRYQVWKAGVTITDNAFLYSLWYFIFSILGNFNNFFFAAHLLDVAVGFKTLRTILQSVTHNGKQLVLTVMLLTIIVYIYTVIAFNFFRKFYVQEEDEEVDKKCHDMLTCFVFHLYKGVRAGSGIGDEIEPPDGDDYEVYRIMFDITFFFFVIVILLAIIQGLIIDAFGELRDQLESVKEDMESNCFICGIGKDYFDKVPHGFDTHVQQEHNLANYMFFLMHLINKPDTEYTGQETYVWNMYQQRCWDFFPVGDCFRKQYEDELGGGGG

SEQ ID NO: 9 - DNA, 16363 bp, Drosophila melanogaster
  misc_feature (15890)..(15890): n = a, c, g, or t
  CDS (1)..(15327)
atggctgaggcggagggaggctccgagcaggatgatgtttcattcctgagaacggaggacatggtcacgctctcctgcacggcgacgggggagcgtgtctgcttggccgccgaaggatttggcaaccggcactgctttctcgagaatattgccgacaagaacgtgccgccggatctttcgcagtgtgtcttcgtcatcgagcaggcgctgtccgtgcgagcattgcaggagttggtgacggcggcaggatccgagactggcaaaggcaccggatcgggacacaggacattgctctatggcaatgccattttgctgcgtcaccacaacagtgatatgtacttggcatgtctgtccacctcctcgtcgaacgacaagctgtccttcgacgtgggcctgcaggagcacagccagggagaggcttgttggtggacggttcatccggcgagcaagcagcgctctgagggcgagaaggtgcgcgtcggagatggtctgatcccggtgtccgtggccaccgaacgttatttgcatacgaccaaggagaacgaacagtctattgtaaatgccagcttccatgtgacccactggtccgtgcagccctacggcacgggcatctctaggatgaagtacgtgggctatgtctttggcggcgatgtgctgcgtttcttccatggtggcgacgagtgcctgaccataccgagtacatggggtcgtgaggcgggacaaaatattgttatttacgagggcggcgtggtcatggcacaggcgaggtccctgtggcgcctggaactcgctcgaaccaagtgggctggtggctttatcaactggtaccacccgatgcgcatacgccacataaccactggacgctacttgggcgtcaacgacagcaacgaactgattctagttaagaaggaggaggcttcgattgccacgacgactttctgcctgcggcaggaaaaggacgacgagaaaaaggtgctggaggacaaggacctggaggtgatcggctcgccgatcatcaagtacggcgacactaccgtcatcgtccagcactgcgagactagcttgtggctcagctacaagagttatgagacgaaaaagaagggcgtaggaaaggtggaggagaagcaagcgatcctgcacgaggagggcaagatggacgattgtctcgacttctcgcgctcccaggaggaggagtccaagacggctcgtgtcatccgcaagtgcagcagcctcttcacccagtttattacagccttggaaacactgcagtcaaatcgccgacactccattttcttccaaaaggtcaacctcaacgagatggtcatgtgccttgaggacttgattaactacttttcgcaacccgaagacgatatggagcacgaggagaaacagaaccgattccgtgccctgcgcaaccgacaggatctgttccaggaggagggcgtgctcaatctgatcctggaggccattgacaaggtcaacataatcacctcgcagggcttcctagccagcttcctggccggcgacgagaccggccagagctgggatctcatctccacctatttgtaccaactcttggccgccatcatcaagggcaaccacacgaactgcgcccagttcgcgaacagtaaccgactcaactggctattctcccgcctcggttcccaggcctccagcgagggttccggcatgttggacgtacttcactgcgtgctgatcgattcgccagaggcactaaacatgatgcgggatgagcacatcaaggtggtcatctccctgctggagaagcacggcagggacccgaaagtcctagacgttctgtgttccttgtgcgtgggtaatggagtggcggtgcgatcctcccagaacaacatttgcgactttttgctaccgggcaagaatctgttgctacagacgctcctggtggaccatgtggccagcatccgaccgaacatcttcgtgggtcgcgtggacggttcttccatgtaccagaagtggtacttcgaggtgaccatggatcacatcgaacagaccacgcacatgatgccccacctgcgcattggctgggctaatacttccgggtatgtaccgtatcccggaggcggcaagaagtggggtggcaatggagtaggcgatgacctgtactcctttggatttgatggtgcctttctttggacgggaggtcgcaaaacactagtggtggacgcgctgcccgaggagccctttatccgtaaaggcgatgttattggcgttgccattgacctttctgtgcccatcatcacgtttacttttaacggagtaaaagtgcgcggtagctttagggactttaacctggacggaatgttctttcccgtgatgagttgctcatcaaaactaagctgtcgcttccttttcggaggtgatcatggtcgtttaaagtttgccccgcccatgggattctctgccctcgtgcagtgtctcatgccgcagcagatcctcagtctggatccttgcttctactttggtaatcttgccaagaatgttttggccggaccatggcttattgaggacgacactgcttttgttccgaagcccgttgataccacgggtgtgacattgccaagttctgtggaccaaatcaaggagaagctggcggagaatatccacgagatgtgggctctaaacaaaatcgaagcgggctggtcgtggggcgagcaccgagatgactaccaccgcatccatccttgcctcacccatttcgagaagcttccggcggcggaaaagcgatacgacaatcaactagctgtgcaaacgctgaagacgattatctcgctgggatactacataaccatggacaagccaccagcacgcattcgcccagtgcgcctgcccaacgagatcttcatgcagggcaatggctacaagccggctccacttgacctaagcgccgtgacactcacccccaagttggaggagcttgtggaccagctggccgagaacactcacaatttgtgggcacgggagcgcatccagcagggttggacttatggtctgaacgaggatagtgaaaaccacaggagtccacacttggtgccatatgccaaagtggacgaggctatcaagaaggccaacagggacacagcgtcggagacagtgcgaacgctcctggtttacggatatgtcttggatcctccgacgggcgaaggaacggaggcacttctggccgaggcacaacgcctcaagttcgccggattccggacttacagggtggagcgcaactacgccgtgacatcgggcaagtggtacttcgaattcgaggtcctcacgtccggaccaatgcgagtgggttgggcacgggccgattgctatccgggagcgatgctgggcagcgaggacaccagttgggccttcgatggacacaatgtgaccaaaatgcacgccggatccattgagcacttcggagtgcggtatgaggctggcgatgtcattggttgtttcatcgatgtcaaggagcaaacgatcagcttctcgttgaacggagaactcctgatggacgcgctgggcggcgagacgacctttgccgacgtaaccgccgagggggtgggcttcgtgcccgcctgcaccctgggagtgggccagaaggcgcgcctcatctacggccaggacgtggactcactcaagttcttcaccacttgtggcctgcaagagggatacgagccgttctgcgtgaacatgcgccgcccggttacccactggtacaccaaggaccagcccatttttgagaacaccgaggagatgcccgactgccgcatcgatgtcacccggattcccggcggcgccgacaccccgccgcacttaaagatctcgcacaacaccttcgagaccatggagaaggccaactgggagttcctgcgtctttccctgcccgtgacctgcatgggtgagtttatcagcgaacaggagaaggccagacgctgggacgagattaagaaccggcagtaccgactaatgcgcgaggcggagatcgctgcccaaatgcaggtccagacacaggccgcccacatggaccacatgttgaaaggtggcttcaatatgaacgacatcaagggcttgacccgtaatttcgatgagcacgcggatgctgaggcagatcacatgatgcgcggacccaaccgtccgcctcgcaagggatcgctcacccgcaacataaccttcgaaacagacatgtccgccgccttggacgagatgcagcgttccacgtcggtgcttgacatgaacgggctgggcgaagagatggatgacaagaagaagcgcggccgcagcccctttaagttcttctcgaagaagtcgcgtgatcagagccgcgaaaagatgggtgctcgcaccctggacacctctctggagcgccgaaatacggtggctcatggtcggaacgtggttaaccagcagatgaccacacgagctccaactctgcggttaaataatgccgaaatccctcccagccctgtgccccagggaccaaagcagttgagtggctcaaatcttggccaacagccggtggaaacttcgggtgacgagatgttcgatgccgagtgcctcaagttgatcaacgagtatttctatggagtaagaatctttcccggtcaggatcccacgcacgtgtacgtcggttgggtcactacgcagtatcacctgcacagccgtgagtttaacaagaacaaggttcgccgtggatcagtctacatcgaggatgactacgagatggccattgaacggatcgaccgccagagttgctatgtagttcgagcggacgagctcttcaacgaggttacccaggatgcctcaggcaagggagcctcacagggcatgttcgttggctgcttcgtggacacagccaccggcatcatccgcttcacttgcgagggcaaggacacctctcaccgctggatgatggagccagacaccaagctcttcccggccattttcgtggaagccaccagcaaggagatccttcagatcgagttgggacgtacccctaccacattgcccctttcggcggcggtactgcccaccagtgacaagcatataaatccacagtccccgccgcgtctgaaggtccagtgcctgcgtccgcatcagtgggctagagttccaaatactgcgctccaggtgcatgcgctgaaactctccgacgtgaggggttggtccatgttgtgcgaggaccccgtgtccatgctggccctgcgcatcccagaggaggatcgctgtatagatattctggagctcatcgagatggacaagcttttgtccttccatgcccacagtctaacgctctatgcggctctttgttaccaatccaattacagagctgcccatgccctgtgccagcatgtggaccagaagcagctgctctacgccatccggtcggagtacatgagcggaccactgcggcagggcttctacgacctgctgatcgccctgcatctggagtcgcatgccacaaccatggaggtgtgcaagaacgagtacatcacaccgctgggagccgagctcaaggaactgtactccgatgaggagatgcagcactcactgagatccctggttacggagtcagtgcgtccgcagctgcggatgacggagatcaccgaaccgatccccgacatcgaccaattgtactccccgaagttccccctagaagtagtcaggcagtttgtcatggaggcgctgaaggatgccgtcgagatcaatcaggtgcacaaccgcgatcccatcggctggaccaacgagaacctcttcctccctctaatcaagctcacagaccggctactcttggtcggcgtcctgactgacgaagatgtccagcggctattggtcatgatcgacccggagacctgggaccaagccttcgaaagagagggtaaggatgagcaccgcaagggcttgctcaccatgaagatggccgagggcgccaagctgcagatgcgctacctgctgcaccatctctacgacacccagctgcgccatcgagtggagagcatcatcgcgttctcccacgacttcgttggcgacctgcagaccgatcagttgcgacgttatatcgagatcaagcaatccgatttgcccagtgctgttgcggccaaaaagactaaagagttccgctgtccgccgcgggagcagatgaaccagattctctgcttcaagaacctcgaacccgatgaccaggacaactgcacctgtggccttgagttgcgcggacgcttgggcgatttccacgattccctcatgcaaaaagtgtcgctcaatgctctccaggagccggatggcgtcgagggcacagcgatcgaggaggtaaagacaggacccatcacgaagatctacaactttattaacaccgtcaaggagctggaggagggccccaaggaggtggaggagccggagaagaagacaccagaggaggtgttccgcaaagttctcattaagacgatcgtcagctgggccgaggagtcacagatcgagaatcccaaactggtgcgcgagatgtttagtctgctgctgcggcagtacgacaccgtcggagaattggttcgtgccctggagaagacgtacgtgataaacacccgagcccgcgacgacgtggcagagatgtgggtgggcctcagccagattcgcgccctgctgcccgtccagatgagccaggaagaggaggaactgatgcgcaagcggctgtggaagctggttaacaacgccaccttctttcagcacccggacctcatacgcatcctgcgtgtccacgagaacgtgatggcagtgatgatgaacacactcggacggagggcacaggcacaaagcgatgcgcccacccagtcggaggtagccgaaggagctccgtccaaggagaaggacacctcccacgaaatggtggtagcttgctgccgattcctctgctacttctgtcgcactggtcgccaaaaccaaaaggccatgtttgatcacttcgactttctgctggacaacgccaacatcctgctggcacggccaagcctgcgaggatccacgcccctcgatgtggcatactcgagtttgatggagaacacagaattggctctggccctgagggaacactatctagaaaagatcgccgtctacctctcgcgatgcggactacagagcaactcggagctcgtggagaagggctatccggatctgggttgggatcccgtcgaaggtgagcgttacccggacttcctgcgctattgcgtttgggtcaacggcgagagcgtcgaggagaatgcgaaccttgtcattcgacttcttatccgtcgtccggaatgcttgggaccggctctaagaggagaaggagagggtctgttccgcgccatcgtcgaggctaatcgcatgtcggagcgcatctcggaccgctgcaagatgcaggacgaggccgagggcaccattgccggtctaaacttcacacatcctctgccggaaggcgaggaggacgaggactatatcgataccggtgccgccattctgaacttctactgcacccttgtggacctactgggccgctgcgctccggacgcttcggtcatcgagcagggcaagaacgagtccctgagggctagagctattctgagatctctggtgccactggaggatttgcagggggtgctcagcctgaaattcaccctctcacagacggcgcccggcgaggagaagcccaaatcggacatgccgtccggcctgctacccaacaataagcagagcatcgtgctcttcctggagcgcgtctacggcatcgaggcacaggacctcttctaccgcctgctggaggacgccttccttccggatctccgcaccgccaccattctggacaagagcgatggatccgagagcgacatggcgctggccatgaaccgctacataggcaactcgatcctgccgctgctcatcaagcactccaagttttacaacgaggccgagaactacgcgagcctcttggatgccactttgcacacggtctaccggctgtccaagaaccgtatgctgaccaaggggcaacgcgaggctgtttccgacttcctggtggccctcacatcccaaatgcaacctgccatgctgctcaagctgctgcgcaagttgactgtggatgtgtccaagctgtccgagtacaccaccgtggccctccggcttctcaccctgcacttcgatcgctgcgccaaatactacggctcaactcaaggccagggctcctatggagcctcatcggacgaggagaagcgcctgacgatgctgctgttctcgaacatttttgactcgctcagcaacatggactatgacccggaactgttcggtaaggcactgccctgtctgatcgccatcggctgcgccctgccaccggactacagcctgtccaagaacacggacgaggactactacggccgccagatgggcgcaccggatcagccgcagtacatgcccaatccgatcgacaccaacaacgtgcatctggacaacgacctcaactcgctggtccagaagttcagcgagcactaccacgatgcgtgggccagtcggcggttggagggtggctggacctacggagacatccgatccgataatgatcgcaagcatcctcgcctgaagccctacaacatgctcagtgaatacgaacgcgagcggtaccgggatccggtgcgagagtgcctgaagggtctgctggccatcggatggaccgtggagcactccgaggtggaggtgccgctgaatcatcgcggatcaacgcggcgtcagtcgaagcctcaaattaacgagggcagcccgttcaactataacccgcacccggtggacatgagcaacctgaccctgagcagggagatgcagaacatggctgagcgcctggcggagaattcccacgacatctgggccaagaagaagaacgaggagctcaacggctgcggtggcgttatccatccgcaactggtgccatatgatcttctgaccgacaaagagaagaagaaggatcgcgagcgctcgcaggagttccttaagtacatgcaataccagggttacaagctgcacaagccatcaaagggaggagctgtggaggagggcggcgccacccaggctgccgttgaactgcgtttctcgtactccctactggaaaagctcatacagtatctggatagagccaccatcaacatgaaactgctaaagccatcgaccacgttcagtcgacgctcatcctttaagacggccacccgggacatcaagttcttctcgaaggtggtgctgcctctaatggagaagtacttctcaacgcatcgcaactacttcatcgccattgccacggcaaccaataatattggagcagcctcgctcaaggagaaggaaatggtggcctcgatcttctgcaagctggccgctctactgcgtaaccggctgagtgcatttggaccggatgtccgcatcacagtacggtgcctccaggtcctggtcaagggcattgatgcacgcaccctgaccaagaattgtcccgagtttattcgcacctccatgctgaccttcttcaaccagacatccgatgacttgggtaacacgatccttaacctgcaggatggcaagtacagtcacctgagaggcactcacctgaaaacctccacatcgttgggatatgtaaaccaggtggttttgccggtgcttactgccatgtttgatcatctggcagcctgcgactatggcagcgatttgcttctggacgagattcaggtggcttcctacaagatcctcgctgcactgtatcatttgggtaccgatggcaccctgacgcatgacaggaagtatcttaagaccgagattgagaggcatagacccgctctgggctcctgtctgggagcttacagctcctgctttccggtggccttcttggagccccaccttaacaagcacaaccagtactcgctgctcaaccgtattgcggatcactcactggaggcgcaggacattatggtcaagatggagagctgtatgccaaatctagagaccattctcgccgaggtcgaccagtttgtggagtcggacaagacatacaatgatgcgcctcatattatcgacgtgatcctgccgctgctttgcgcctatctaccgttttggtggtcccagggaccggataatgtcagtcccaccagtggcaaccacgtgaccatggtcacagccgatcacatgaatccgttgctgcgaaatgtgcttaaaatgatcaagaagaacattggcaacgataacgccccttggatgactcgcattgccgcctatacgcagcagattatcatcaatacgtcggaggagctgctcaaggatccgttcttgccgctggcggagcgggtgaagaagcgcactgagaacatgctgcacaaggaggacagcatgcgaggattcatcaagtcggccacggacgacacttcgcaggtggagacccagctgcaggaggactggaatctgctagtgcgagacatatactcgttctatcccctgctcatcaagtacgtggatctgcagcgaaaccactggctgaaggacaacataccggaggccgaggagctctacaaccatgtggcagagatcttcaatatatggtctaagagccagtacttccttaaggaggagcagaacttcatctctgccaatgagatcgacaacatggccttgatcatgccaactgcaaccaggaggtcggccatctcggaaggtgctcctgctgtgggtggcaaggtaaagaagaagaagaagaacagggacaagaagcgcgacaaggacaaggaggtgcaggccagtctaatggtggcctgcctgaaacgcctcctacccgttggactgaatctgttcgcgggtcgagagcaggaactggtgcagcactgcaaggatcggtacctgaagaagatgcccgagtacgatgtgatcgagttcgcccgcaaccagctgaccctgccggataagctggacccgtcggacgagatgtcctggcagcattacctttactcaaagctgggcaagacggaggaaccggtggacgaacaggcgctggagaaggccaatgttaactccaacgagaagggcaaggacaaaacccaggagacagtggatcgcatcgtggcgatggccaaggttctgtttggcctgcacatgatcgaccatccacaacagcagagcaagaatgtctacaggagcgttgtgtcgatccaaaggaagcgtgccgtaatcgcatgcttccgtcagacatcgctgcattctctacccagacatcgggcctgcaacatcttcgcacgatcgtactacgagcagtggctgcaggaggagaacgtgggccaagaggtgatggtcgaagatctgacgcagacgttcgaggactccgagaaatccaagaaggagggcgaggagacggacagcaagccggatccgctaacccaactggttaccactttctgccgcggcgccatgacggaacgcagcggtgccctccaggaggatctgctctacatgtcctatgcccagatcgcggccaagtccacgggcaaggaggaggaggaaggcggcgacgaagaaggcggtgagggtggcgaagaggccgaaggcaccagcatccatgaacaagagatggagaagcagaagctgctcttccatcaggcacgtctctccaatcgtggcgttgccgaaatggtgctgttgcacgtttccgcctccaaaggtataccttcggagatggtaatgacgacactcaatctcggcatcgccattttgcgcggcggcaacatcgacatccaaatgggcatgctgaaccacttgaaggaaaagaaggacgttggcttctttacctccatcgccggactgatgaactcctgcagtgtactggacctggacgcctttgagcgaaacaccaaagcagagggtcttggtgtaggttccgaaggcgccgcgggcgagaagaacatgcacgacgcggagttcacctgtgcgctgttccggttcatccagctgacctgcgagggccacaacttggaatggcaaaactatttgaggacccaggcgggtaacaccaccaccgtgaacgtggtcatctgtactgtggattatttgcttcgtctgcaagagtccatcatggacttctactggcactactccagcaaagagatcatcgatcccgctggaaaggccaacttcttcaaggccatcgaagtggctagccaagtatttaacaccctcactgaagtcatccagggtccttgtaccctcaatcagcaggccttggcacactcgaggttgtgggatgcagttggtggcttcctcttcctgttttcccacatgcaggacaagctgtcaaagcactccagccaagttgatctgctcaaggaactgctgaatctgcaaaaggacatgatcaccatgatgctttccatgctggaaggaaatgttgttaacggcactattggcaagcagatggtggacacgctggtggagtctgccagcaatgtggagctgattcttaagtacttcgacatgttcctgaagctcgccgaccttatcgaatcgcccagcttccacgaagtggacatgaagaacgagggttgggtgacccccaaagactttagggaaaagatggagcaatccaagaactacacaccggaagaaatggatttccttttggcctgctgcgagcgcaaccacgagggcaagatcgattaccgggccttcgtggagcacttccacgaaccatcaaaggagatcggtttcaacctggctgtgctcctgaccaacctcagcgaacacatgccaaacgaaccgcgcctggcgcgcttcctggagaccgccggctcggtgctcaactacttcgagcccttcctgggccgcatcgagattctcggcagctccaagcgcatcgagcgcgtttactttgagatcaaggactcgaacatcgaacagtgggagaagccccagattcgcgagtccaagcgtgccttcttttattccatcgtcaccgaaggtggcgacaaggagaaactggaggcctttgtgaacttctgcgaggacgccatctttgagatgacccacgcctcgggacttatggccaccgatgatggcggtggcaatgtgaagcgggacactgcctatagttcctatatgagcgaggaagaggaggagcgagccgctcgtgatcccatccgccgcaccatcaccgccgtcaaagaaggactcaagttcggagtgcacatgcttagtccggcgaacatcaagcatcagatcggagtgatgcagaccaaatccataccagaactcatagtcggctttttcaagatcatcttctatatattttactataccggatatgcacacttctgcgtggtgcgttacatattcggcatcctactgaacctgatgcgaggacctgctccagagcaggaggaggaaccggtagtggaggaggaaacgtttggaagagcactgccaccgctgtcgcttgaagaaccaccgggcacggtgcaagcctttgggctggacatcaacaaggaggagaacggcatgtacaaggtggtggtgcacgaatctccagccaattcctcgatggaggagggcggagaatccagtcccgaggacggagcagctgccagcggcgaattggtcgaaggtgaaccacaccaggggcccatttccattgtggatctgctgggtggagaggctgcaaagaaggcggcacaggagcggcaggaggcgcaaaaggctcaggaggccgctatggcctccatcgaggcggaagccaagaagtcgtcatctgcgcctcaggagactccagctgttcaccagatcgacttttctcagtacacccatcgcgccgttagcttcctcgccagaaacttctacaacctcaagtatgtggccttggtgctggctttcagcattaacttcatgctgctcttctacaaagtcacctcgtttaccgaagaagcagacagctctgccgaagaggagctcatcctgggctccgggccgggaggaggtgcggacatcacgggctctgggtttggcggatcaggggacggaggatcgggcgatggcgaaatggaggacgagataccggaacttgtgcacgtggacgaagacttcttctacatggaacacgttctccgcattgcggcatgtctgcactcacttgtctccctggccatgttgattgcctactaccacctcaaggttccattggccatcttcaagcgggaaaaagagattgcccgccggctggagttcgagggattgttcattgcagagcagccggaggatgacgacttcaagtcgcactgggacaagctggtaatttcggcgaaaagtttcccggtgaactactgggacaagttcgtgaagaagaaggtgcgccaaaagtacagcgagacctacgactttgattcgatctctaatctgctgggcatggagaagagcacgttcgcggctcaggagagcgaggaaacgggcatcttcaagtacatcatgaacatcgactggcgctatcaggtgtggaaggctggcgtcaccttcacggacaacgccttcctctactcgctgtggtacttcagcttctcggtgatgggtaacttcaacaacttcttcttcgccgcccatctgctcgatgtggccgtgggcttcaagaccctgcgcaccatcctgcagtctgtgacccacaacggcaagcaactggtgctcaccgtgatgctgcttaccatcatagtgtacatctacactgtgatcgcgttcaacttcttcaggaagttctacatccaggaggaggacgaggaggtggacaaaaagtgccacgacatgttgacctgcttcgtgttccatctgtacaagggtgcgagagcgggcggtggaataggcgacgagatcggggatccagatggagacgactacgaggtctaccgcatcatcttcgatatcacgttcttcttcttcgttattattatcctgctggccattatccagggtctgatcatcgacgccttcggcgagctgcgtgaccaactggagtcggtgaaggacaacatggagtccaactgcttcatctgcgggatgggcaaggacttcttcgacatagtaccgcacggcttcgacacgcacgtccagaaggagcacaacttagccaactacatgttcttcctgatgcatttgattaacaagccggacacggagtataccggccaggagacgtacgtgtggaacatgtaccagcagcgcagctgggacttcttcccagtgggagactgcttccgcaagcaatacgaggatgagctttccggcggaggcggcggcggctaaatgactgcggattcgccgcgtctgatttctgggcacaatcacactggcactggacggtcgtttaaaccgggtaagcctatccctaaccctctcctcggtctcgattctacgtgatctagagggcccgcggttcgaaggtaagcctatccctaaccctctcctcggtctcgattctacgcgtaccggtcatcatcaccatcaccattgagtttatctgactaaatcttagtttgtattgkcatgttttaatacaatatgttatgtttaaatatgtttttaataaattttataaaataatttcaacttttattgtaacaacattgtccatttacacactcctttcaagcgcgtgggatcgatgctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactatnaagataccaggcgtttccccctggaagctccctcctggacggtccaaggactctcgggatccaattttgtatcggtagtttgacaacatctggaatttttacctagtcaactttagcaatgtattttaagcaatatcctacacaatcgtttttatgtacgtagaggagtacgacctgtttccaaactgaaatattgatgacgattctagcacgtataacaacaaatgttcttaactcattttgaaataaatctattcattttgaacgaacccctttggtcttcgatattttatttattcccgtttagatcgtcaagaagaacaaattttgttttgggtaaatatttaattactttcgaacattaagacttgtcatctcaaatatcaaggctggttagtcgaattatttacaagaatagagcaaaagcttgtaaattttcggaatacctttccataatgtaaaaacagtcattt

SEQ ID NO: 10 - protein, 5109 aa, Drosophila melanogaster
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDGLIPVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWAGGFINWYHPMRIRHITTGRYLGVNDSNELILVKKEEASIATTTFCLRQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKVNIITSQGFLASFLAGDETGQSWDLISTYLYQLLAAIIKGNHTNCAQFANSNRLNWLFSRLGSQASSEGSGMLDVLHCVLIDSPEALNMMRDEHIKVVISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETVRTLLVYGYVLDPPTGEGTEALLAEAQRLKFAGFRTYRVERNYAVTSGKWYFEFEVLTSGPMRVGWARADCYPGAMLGSEDTSWAFDGHNVTKMHAGSIEHFGVRYEAGDVIGCFIDVKEQTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALRIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMRYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTLGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYPDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARAILRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVPLNHRGSTRRQSKPQINEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNLQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILAEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEAEGTSIHEQEMEKQKLLFHQARLSNRGVAEMVLLHVSASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLTEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLSLEEPPGTVQAFGLDINKEENGMYKVVVHESPANSSMEEGGESSPEDGAAASGELVEGEPHQGPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGPGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGARAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 11 - DNA, 20 bp, artificial sequence
  PCR primer A-F1
  misc_feature (6): n = a or g
  unsure (9): n = a, c, g or t
  misc_feature (10): n = c or t
  unsure (12): n = a, c, g or t
  misc_feature (15): n = c or t
cctgangcnntnaanatgat

SEQ ID NO: 12 - DNA, 20 bp, artificial sequence
  PCR primer A-F2
  misc_feature (9): n = a or g
  unsure (12): n = a, c, g or t
  misc_feature (13): n = c or t
  unsure (15): n = a, c, g or t
  misc_feature (18): n = c or t
gatcctaangtnntngangt

SEQ ID NO: 13 - DNA, 20 bp, artificial sequence
  PCR primer A-F3
  misc_feature (9): n = c or t
  misc_feature (12): n = c or t
  misc_feature (15): n = a or g
  misc_feature (18): n = c or t
aagtggtanttnganttnga

SEQ ID NO: 14 - DNA, 23 bp, artificial sequence
  PCR primer A-R1
  misc_feature (6): n = c or t
  misc_feature (9): n = a or g
  misc_feature (12): n = a or g
  misc_feature (18): n = c or t
  unsure (21): n = a, c, g, or t
tcgaantcnaantaccanttncc

SEQ ID NO: 15 - DNA, 20 bp, artificial sequence
  PCR primer A-R2
  misc_feature (6): n = c or t
  misc_feature (9): n = a or g
  unsure (12): n = a, c, g, or t
  misc_feature (15): n = c or t
  misc_feature (18): n = c or t
aatggntcntanccntcntg

SEQ ID NO: 16 - DNA, 20 bp, artificial sequence
  PCR primer D-F1
  misc_feature (9): n = c or t
  misc_feature (12): n = c or t
  unsure (15): n = a, c, g, or t
  misc_feature (16): n = a or t
  misc_feature (17): n = c or g
  unsure (18): n = a, c, g, or t
gagcaggangangtnnnntt

SEQ ID NO: 17 - DNA, 20 bp, artificial sequence
  PCR primer D-F2
  misc_feature (9): n = a or g
  unsure (12): n = a, c, g, or t
  misc_feature (15): n = c or t
  unsure (18): n = a, c, g, or t
gctgctganggnttnggnaa

SEQ ID NO: 18 - DNA, 20 bp, artificial sequence
  PCR primer D-F3
  misc_feature (6): n = a or g
  unsure (9): n = a, c, g, or t
  misc_feature (12): n = c or t
ggtgangcntgntggtggac

SEQ ID NO: 19 - DNA, 20 bp, artificial sequence
  PCR primer D-R1
  misc_feature (9): n = a or g
  unsure (12): n = a, c, g, or t
  misc_feature (15): n = c or t
  unsure (18): n = a, c, g, or t
gtccaccancangcntcncc

SEQ ID NO: 20 - DNA, 20 bp, artificial sequence
  PCR primer D-R2
  misc_feature (5): n = g or t
  misc_feature (9): n = c or t
  misc_feature (12): n = c or t
  unsure (15): n = a, c, g, or t
  misc_feature (18): n = c or t
actcntacnttntcnccntc

SEQ ID NO: 21 - DNA, 20 bp, artificial sequence
  PCR primer D-R3
  misc_feature (11): n = a or g
  misc_feature (12): n = a or g
  misc_feature (15): n = c or t
  misc_feature (18): n = a or g
ggtattgttanncantcntc

SEQ ID NO: 22 - DNA, 23 bp, artificial sequence
  PCR primer D-R4
  misc_feature (9): n = a, c, g or t
  misc_feature (12): n = c or t
  misc_feature (15): n = c or t
  misc_feature (18): n = c or t
  misc_feature (21): n = a or g
tttagtacnccntcntcntgnaa

SEQ ID NO: 23 - DNA, 24 bp, artificial sequence
  PCR primer WL3
cacacactgcgacagatcaggcgg

SEQ ID NO: 24 - DNA, 26 bp, artificial sequence
  PCR primer WL4
gcaatattctccaggaagcagtgccg

SEQ ID NO: 25 - DNA, 38 bp, artificial sequence
  PCR primer pHVN3-PacI
gccaagttaattaaccatggcggaagcagaggggggag

SEQ ID NO: 26 - DNA, 41 bp, artificial sequence
  PCR primer pRhC1-PmeI
ggactcgtttaaacgattctcccatgaggtcttcgtattgc

SEQ ID NO: 27 - DNA, 20 bp, artificial sequence
  PCR primer E-F1
  misc_feature (9): n = a, c, g or t
  misc_feature (12): n = a, c or t
  misc_feature (15): n = a, c, g or t
  misc_feature (18): n = c or t
ggaggtggnatnggnganga

SEQ ID NO: 28 - DNA, 20 bp, artificial sequence
  PCR primer E-F2
  misc_feature (9): n = c or t
  misc_feature (12): n = a, c, g or t
  misc_feature (15): n = c or t
  misc_feature (18): n = a, c, g or t
atcatcgangcnttnggnga

SEQ ID NO: 29 - DNA, 20 bp, artificial sequence
  PCR primer E-R1
  misc_feature (3): n = a or g
  misc_feature (6): n = a or g
  misc_feature (9): n = a, c, g or t
  misc_feature (12): n = a, c, g or t
  misc_feature (15): n = a, c, g or t
  misc_feature (18): n = a or g
aancantcnccnacnggnaa

SEQ ID NO: 30 - DNA, 20 bp, artificial sequence
  PCR primer E-R2
  misc_feature (3): n = a, c, g or t
  misc_feature (6): n = a or g
  misc_feature (9): n = a or g
  misc_feature (12): n = a or g
  misc_feature (18): n = a or g
acnggnaanaantcccanca

SEQ ID NO: 31 - DNA, 26 bp, artificial sequence
  PCR primer F-R1
ccctcttgagaacttgcagctgtcac

SEQ ID NO: 32 - DNA, 27 bp, artificial sequence
  PCR primer F-R2
cgtccggtgtccagatccagttccgcc

SEQ ID NO: 33 - DNA, 27 bp, artificial sequence
  PCR primer F-R3
gatgaacagtccaccaacaagcttcac

SEQ ID NO: 34 - DNA, 26 bp, artificial sequence
  PCR primer G-F1
gctggaaagcgtcaaggaagacatgg

SEQ ID NO: 35 - DNA, 26 bp, artificial sequence
  PCR primer G-F2
gcggtatcggcaaagattatttcgac

SEQ ID NO: 36 - DNA, 25 bp, artificial sequence
  PCR primer G-F3
gtgccgcatggtttcgacactcacg

SEQ ID NO: 37 - DNA, 40 bp, artificial sequence
  PCR primer pRgN-PacI
gccaagttaattaacgatggccgacagcgagggcagttcg

SEQ ID NO: 38 - DNA, 38 bp, artificial sequence
  PCR primer pRgC-PmeI
ggactcgtttaaacgagacgcctcctccgccgccgagc

SEQ ID NO: 39 - DNA, 82 bp, artificial sequence
  vector MCS with PacI and PmeI sites inserted between BamHI and XbaI
ggatccttaattaacggtccggtttaaaccgggtaagcctatccctaaccctctcctcggtctcgattctacgtgatctaga

SEQ ID NO: 40 - DNA, 29 bp, artificial sequence
  PCR primer CMA-DR1
gctggatgcacagtccaccaacaagcttc

SEQ ID NO: 41 - DNA, 27 bp, artificial sequence
  PCR primer CMA-DR2
caatgttcggtgtccagatccagttcc

SEQ ID NO: 42 - DNA, 30 bp, artificial sequence
  PCR primer CMA-DR3
gacgggtacacactgagacaagtcgggtgg

SEQ ID NO: 43 - DNA, 26 bp, artificial sequence
  PCR primer CMA-EF1
ctgcggcatcggcaaagattatttcg

SEQ ID NO: 44 - DNA, 25 bp, artificial sequence
  PCR primer CMA-EF2
ccgcacggttttgacacgcacgttc

SEQ ID NO: 45 - DNA, 26 bp, artificial sequence
  PCR primer CMA-EF3
ccggccaagaaacgtacgtctggaac

SEQ ID NO: 46 - DNA, 24 bp, artificial sequence
  PCR primer CPH-DR1
ccgaagcacatcgccaccaaacac

SEQ ID NO: 47 - DNA, 25 bp, artificial sequence
  PCR primer CPH-DR2
cctgtgccataaggctgaacggacc

SEQ ID NO: 48 - DNA, 29 bp, artificial sequence
  PCR primer CPH-DR3
cgtcaccaactcgcaccttctcaccctcc

SEQ ID NO: 49 - DNA, 34 bp, artificial sequence
  PCR primer CPH-EF1
ggaagacatggagtccaactgtttcatttgtggc

SEQ ID NO: 50 - DNA, 31 bp, artificial sequence
  PCR primer CPH-EF2
gtgccgcatggtttcgatactcatgtgcagc

SEQ ID NO: 51 - DNA, 35 bp, artificial sequence
  PCR primer CPH-EF3
gcataatctcgctaattacatgttcttcctcatgc

SEQ ID NO: 52 - DNA, 40 bp, artificial sequence
  PCR primer pRCMAN-PacI
gccaagttaattaacgatggccgacagcgagggaagttcg

SEQ ID NO: 53 - DNA, 38 bp, artificial sequence
  PCR primer pRCMAC-PmeI
gaactcgtttaaacgagacgcctcctccgccgccaagc

SEQ ID NO: 54 - DNA, 41 bp, artificial sequence
  PCR primer pRCPHN-PacI
gccaagttaattaacaatggcggatagtgagggtggatctg

SEQ ID NO: 55 - DNA, 40 bp, artificial sequence
  PCR primer pRCPHC-PmeI
gaagtcgtttaaacgagccaccaccgcctcctaactcatc

SEQ ID NO: 56 - protein, 5126 aa, Drosophila melanogaster
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFSWQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETSANAPGLRICLGSSDGRRNGGTSGRGTTPQVRRIPTYRVERNYAVTSGKWYFEFEVLTSGPMRVGWARADCYPGAMLGSEDTSWAFDGHNEEKVYGGVSESFGKQCGPGDIVGVFLDLADHTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITPPVIATSSMPSVSSEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTIGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARASLRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVPLNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNQQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILGEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLIEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 57 - protein, 4868 aa, Anopheles gambiae
DMVCLSCTATGERVCLAAEGFGNRHCFLENIADKNIPPDLSQCVFVIEQALSVRALQELVTAAGSETGKGTGSGHRTLLYGNAILLRHNNSDMYLACLSTSSSNDKLSFDVGLQEHSQGEACWWTVHPASKQRSEGEKVRVGDDLILVSVATERYLHTTKENDLSIVNASFHVTHWSVQPYGTGISRMKYVGYVFGGDVLRFFHGGDECLTIPSTWSLDSGQNIVVYEGGSVMSQARSLWRLELARTKWAGGFINWSHPMRIRHLTTGRYLGVNENNELILMSRDQATTSQTAFVLRLEKDDQKVVLEDKDLEIIGAPIIKYGDSTVIMQHYESGLWVSYKSYETKKKGVGKVEEKQAILHEEGKMDDGLDFSRSQEEESRTARVIRKCSSLFTKFISGLETLQENRRHSIFLQTVNLGEMVMCLEDLINYFAQPEDDMEHEEKQNRLRALRNRQDLFQEEGVLNLILEAIDKINVISSQGFLASFLASDESGQSWDMISGYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTGLVDHVASIRPNIFVGRVEGSAIYQKWYFEVTMDHIEQMTHMTPHLRIGWANTAGYVPYPGGGEKWGGNGVGDDLFSYGFDGVYFWSAGRRTCVVPREVTEPFIKKGDVIGCTLDLSVPVIRFTFNGEPVQGCFTDFNLDGMFFPVMSCSSKLSCRFLFGGDNGRLKFNPPPGFSPLVQCLMPHQNLSLDPCFYFGNLNKNVLAGPWLVEDDSAFVPKPVDTSIVTLPSSVETIKDKLAENIHEMWALNKIEAGWTWGERRDDVYRIHPCLTSFEKLPAAEKRYDCQLAVQTLKTILALGYYISMDKPPARIRPIRLPNDPYMQGNGYKPAPLDLSAAVLTPKMEELVDQLAENTHNLWAKERIQQGWTYGLNEDSENLRSPHLVPYSKVDEAIKKANRDTASETVRTLLIYGYNLDPPTGEANEALAAEALRQKFAAYRTYRVERTYAVTSGKWYFEFEVLTAGPMRVGWARADCNPGTMLGSDDASWAFDGYNIGQKARVVYGQDVDSLKWFTTCGLQEGYEPFCVNMKRPVTHWYTKDQPIFENTDEIPECKIDVTRIPGGADTPPCMKISHNTFETMEKANWEFLRLSLPVTCANTFITEQEKMRRWEEIRIRQHRLMTEVDHSAPAHFDHIMRSGFTMNDIKGLHRNYSEDAAEADEMMRNGPRRPSRHQGRGGLSPPGIEINGEATSDGELNAYSDNELEGGDDRKKRGRSPFRLFGKKRDQSKDKLKDRRTPEPEPRKSNLKVTQRGQATRMSNSDLRAQAPLTPERKGMGSPQVESFGNEVYDADCLRLINEYFYGVRIFPGQDPTHVYVGWVTTQYHVHSKEFSQNKVRHAAIYVEDENEKTIEIVNRQSCYMVRADELFNEVTQDSSGKGASQGMFVGCFVDTATGTIRFTCEGKETSHVFLMEPDTKLFPAIFVEATSKEILQIELGRTPTTLPLSAAVLPTSDKHINPQFPPRLKVQCLKPHQWARVPNTALQVHALKLSDIRGWSMLCEDPVSMLALHIPEEDRCIDILELIEIDRLLQFHAHTLTLYSALCYQSNYRAAHALCSHVDQKQLLYAIQSEYMSGPLRLGFYDLLISLHLESHATTMEVCKNEYIIPLGSELRELYIDPEMCHSLRSLQTLSVRPEMNMTEIAPTPSQSNMPTIVAPDSSSEPIPAIDSLYSPRFPLEVVREFVMSALQEAVQINQVHNRDPIGGSNENLFLPLIKLIDRLLLVGVITNEDVEKLLIMIDPETWDPSFEKEGRDEHRKGLLTMKMAEGAKLQMCYLLHHLYDVQLRHRVESIIAFAHNYVGDLQQDQLRRYIEIKQSDLPSAVAAKKTREFRCPPREQMNAILGYKNLEEDDLENASCGPELRNRLIEFHEKLMGKVSLNALQEPEEPEADKLEEGRPGAMKKLYNFINAVKELEEDPKEPVEEEKKTPEEVFRKVLIKQLVSWAEESQIENPKLVREMFGLLVRQYDTIGELIKALNKTYVINSKTKGDVANMWIGLSQIRALLPVQMSQEEEELMRKRLWKLVNNHTFFQHPDLIRILRVHENVMAVMMNTLGRRAQAQSDAPVQTADGEESAPKEKDTSHQMVVACCRFLCYFCRTGRMNQKAMFDHFDFLLENSNILLSRPSLRGSTPLDVAYSSLMENTELALALREHYLEKIAIYLSRCGLQSNSELIERGYPDLGWDPVEGERYLDFLRFCVWVNGESVEENANLVIRLLIRRPECLGPALRGEGEGLLKAIVDANKMSERISERRKMQDEAEGTITGLNFSHPLPEGDDDEDYIDTGAAILCFYCTLVDLLGRCAPDAAVIEQGKNESLRARAILRSLVPLEDLQGVLSLKFTLTNPALGEDRPKSDMPSGLVPGHKQSIVLFLERVYGIETQELFYRLLEDAFLPDLRAATMLDRSDGSESDMALSMNRYIGNSILPLLIKHSKFYNEAENYASLLDATLHTVYRMSKNRMLTKGQREAVSDFLVALTSAMHPAMLLKLLRKLTIDVSKLSEYTTVALRLLTLHYERCAKYYGTTGGGQASQFGASSDEEKRLTMLLFSNIFDSLSNMDYDPELFGKALPCLIAIGCALPPDYSLSKNSDDDLYGKPTGGGPDQPHYNPQPIDTTAVQLTNDLNQIVQKFSEHYHDAWASRKLENGWTYGDQWSDANKTHPRLKPYNTLSEYERERYREPVRESLKALLALHWRIEHSEGDVPLSNRGSMRRQSKPNLELQGDTGSPFNYNPHPVDMTNLTLSREMQNMAERLAENSHDIWAKKKNEELDQCGGAIHAQLVPYDLLTDKEKRKDRERSQEFLKYLQYQGLKLHKPSRGQTEEPGMSTAAIELRFAYSLLEKLISYSDRATINMKLLKPSSTFSRRSSFKTCSRDIKFFSKVVLPLMEKYFSSNRNYFIAIATATNNVGAASLKEKEMVAGLFCKLASLLRHRLAAFGADVRITVRCLQVLVKSIDAKSLVKNCPEFIRTSMLTFFNNTADDLGQTIVNLTDGKYDRLRGTHLKTSTSLAYVNQVILPVLTSLFDHLAACDYGSDLLLDEIQVASYKILSALYTLGTDTSLTRDRKYLKTELERHKPALGSCLGAFSSCFPVAFLEPHANKHNPFSLLNRIADTSLEAQDIMSKMESCMPTLESILSEVDQFVESEKTYQEAQHIIDVILPLLCSYLPFWWNQGPDNVSPQSGNHVTMVTADHMNHLLKNVLKMIRKNIANENAPWMTRIATYTQQIIINSSEELLKDVFLPLAERVKKRCDSMFHKEESLRGFLKSSTDDTSQIEAQIQEDWQLLVRDIYSFYPLLIKYVDLQRNHWLKDNVAEAEELYNYVAEIFNVWSKSQYFLKEEQNFISANEIDNMTLIMPTATRRSAAVSGDMPASGGKVKKKKRSRDKKRDKDKEIQSSLMVACLKRLLPVGLNLFAGKEQELVQHCKDRYLKKMPEYEVIEFARTQLTLPDKLDPADEMSWQHYLYSKLGKKEQIVQDTLEKSDKKPENKIEDTVERIVAMAKVLYGLHMEQEMEKQKLLFHQARLANRGVAEMVLLHISASKGVPSEMVMRTLELGIAVLRGGNIDIQMGMLNHLKEKKDVGFFTSIAGLMNSCSVLDLDAFERNTKAEGLGVGSDGAAGEKNMHDAEFTCALFRFIQLTCEGHNLDWQNYLRTQAGNTTTVNVVICTVDYLLRLQESIMDFYWHYSSKELIDPAGKANFFKAIGVASQVFNTLTEVIQGPCTQNQQALAHSRLWDAVGGFLFLFSHMQDKLSKHSSQVDLLKELLNLQKDMITMMLSMLEGNVVNGTIGKQMVDTLVESASNVELILKYFDMFLKLKDLTSTPSFMEIDSNGDGWIMPKDFREKMEQQKSYTPEEIDFLLACCETNHDGKIDYIGFVDRFHEPAKEIGFNLAVLLTNLSEHMPNEPRLARFLETAGSVLNYFESFLGRIEIMGSSKRIERVYFEIKEANIEQWEKPQIKESKRAFFYSIVTEGGDKEKLEAFVNFCEDAIFEMTHASGLMASDDDGGTVRRDQAFTYISEEEEERAARDPIKRTIQAVKDGLSYSMYMISPSNIKHQITVLQSKSFPEIIVGFFKMIFYAFYYSGFGVSVVIKYLVNILMSLMRGPAQEEEEPIPEAEPSLRALPPLPLEEPPGTVQAFGLDISKEENGQYRMAPHESPALSPSSSIEETGESSPEDGAAELTGEGVPPGEQMTLVDLLGGEAAKRAAQERTEAQKAQEATLASIEAESKKASTETKEPAAVHQIDFSKYTKKCVSYLARNFYNLKYVALVLAFCINFMLLFYKVTTLGDDEDGEGGSGESLMGLGSGLGSGLGILETGSGGGEGGSGDGEGEEEDPPEKVHVDEDFFYMEHVLRIAAILHSLVSLCMLIAYYHLKVPLAIFKREKEIARRLEFDGLFIAEQPEDDDIKSHWDKLVISAKTFPVNYWDKFVKKKVRQKYSETYDFDSISNLLGMEKTAFAAQEANEGGGFFHFITNIDWRYQIWKAGVTITDNSFLYSLWYFSFSVMGNFNQFFFAAHLLDVAVGFKTLRTILQSVTHNGKQLVLTVMLLTIIVYIYTVIAFNFFRKFYVQEDDDGEEGDRKCHDMATCFVFHLYKGVRAGGGIGDEIGDPDGDEYEVYRILFDITFFFFVIVILLAIIQGLIIDAFGELRDQLESVKEDMESNCFICGIGKDYFDKVPHGFDTHVAQEHNLANYMFFLMHLINKPDTEYTGQETYVWNMYQQRCWDFFPVGDCFRKQYEDELGGGGS

SEQ ID NO: 58 - protein, 5071 aa, Caenorhabditis elegans
MADKEEQGGGEQDDVSFLRTGDIVCLSCVASHNRDGVLGSERVCLCTEGFGNRMCTLENVSDKDIPPDIAMCMLYIDNALSMRALQEMMSADSDHKSASGAGGHKTLLYGHAVQLKHVQSEMYLACLSSCSSNDKLAFDVGVQETNEGEACWWTIHPASKQRSEGEKVRVGDDVILVSVATERYLHMAYSKGYMVIASFHQTLWNIQSVSSGSMRTRNMGFLFGNDVLRLFHGNDECLTIPENWSEHPQHNMVIYEGGAAVTQARSLWRVELIRMKWHGALVGWEQVFRIKHITSGRYLGVLDNSVQLYHKEKADFDLTAFVMCQNKDPKKQMLDEKEEEGMGNATIRYGETNAFIQHVKTQLWLSYQTTEVTKKGLGKVEEKKAVALKDGHMDDCYTFFMALEEESKSARVIRKCSSVLNKFLKGIDALQLEGNQSTDWTRVDLNEVLKLMEDLIEYFAQPNDEQDFEEKQNHLRALRSRQDLFQEEGVLNMILDTIDKFSQMEALPDFAGLIGEETHVKWEQISTYLYLLVAAMIKGNHYNCAQFASAQRLDWLFGRLSNPQSAEGILDVLYCVLTESPEALNMINEGHIRSVISLLEKVGRDPKVLDVLSSLCEGNGMAVRSSQNLITQYLLPGKDLLLQTSMRDHVSSMMPNVMLGVVEGSALFRKWYFEAEVEHIETMTKQTPYLRIGWANSVGFKPFPGSGDKMGCNGVGDDFYSYGFDGKSMYFGGKSRRVGHKLLEKGDVIGCSIDLTIPEIKFSVNGTYMSGSFKKFNIDGYFFPVMSLSAKVSCRFILGGNQGRLRYGPPTGFSAVVEAVNGELQITDCLSFGDLGKNIFSGPQTIFNNLEPFIPTPIDVSATQLNHHATEMHQKYAENLHELWAMRKIELGWSYGETRSETSRKHPCLTKFEYLPETEKKYNILLALTTMKTIEALGYHLITEDPPCRLRAVRLGPNFQQQNGYKPGPLDTHEIQLPAELQPLTEALARNTHNIWAKEKIKRGWTFGLSEHVDATQKRSPHLVPYEQVDERIKQANRESAAENIRALQLFGIFLEPPAHEHDEVAEKELRARKDNTRTYRAEATYAVCGGKWYFEFEILTAGYMKIGWMDIGSTPEIQLGADDRSYAFDGYLGRKWHQGAETYGKEWKIGDVVGCFLDLNDRTISFSLNGELLLDPSGSEMAFDNVVCGDGLVPAMTLGSGQRGRLNFGQQSNSLKFFTTCGLQEGYEPFCVNMYRTMPMWFAKHFPRFEDISTLKSGSILEVSRIPATGNSPPCLKILQKVTISEGGPSEKAKMEYIKLSLPVKCNDTFVKNKDKETIRRQLQEYKPRSQSVVSQIRAPGIPKEFDDNKEKKGFLRSMLGSKDSHESDDDRRSRTNSKQPSVDGDEPPAVRRSLLELPHDERQIAEDSMRDLNDRHSEKPKKGGLLSRLRDSSNTRKNFRDSDRRKEEKAAQLRQMKANSRSFDAGSLDTSTLPTGQKDVLASSEMPLSGPGRQLTIKRSSIKKNKKGKKAEIALEKMEREKKGSIIPMDAQLDVLQEGDAHALVHHKDKVDEYYYGIRIFPGQDPSQVWVGWVTTQYHYYNVNFDGSQGVRKCRFSEADHHGTTVDSVQSQNCYMVNVSELLATTPDVANTKVSGTLIGCIIDTSIGELSFQVGSTDTGIKFKLEPGAMLFPAAFVTPTATEILQFELGRIKYTFPLSAAMFKSCEKSLVPFCPPRLTVEQIESVYWARVPNETLRTTALKLSEVRGWSVLCNDPVRIMSVYIPEKDQSLDILEMIEMPDMLEFHRQTLNLYCKLASHGNHKVAHTLCQHIDEDQIMYAIKSHYLSGPMRQGFHDLLIGLHLMSHTAARNSMAKEYVIPLVPQLQIKNVLDPDSESRYPQITGESVSMLSQMASEPVKKHVSREDEMKLLPPSVDFEALKKHVMESLQSATHHAVMNCRDLIGGDNTNHFEPLFKLFDQLLVIGLINDEELECLLRLIHPQAFDENYETGTTQKGLTQLELAEPVKIQLVSILDHLCDIQLRYRIESLVAFTEGFVGELQSDQCKRYMEIKQTDMPPAEAAKKTKEFRCPPKEQMFRLLMCKVKEERDPELMEEDADVDQCPMAEGLQQQLRDFCELLVGKIGNVKEGDSDDQLALIESEEGSWVDSFARIVVKVPPPVLEEGMEMQKKGTQNFREIIVTMLREWAQADFIESKSLIRNMFRLLLRQYSGIREIRDAMSQTYVFHERNEKDVTDFLVYLIQIRELLTVQFEHTEEAILKRGLWKLMNNRIFFQHPDLMRLLSVHENVMSIMMNILTAQQGTVEHEGDELKEKAPIKDASEMVVACSRFLCYFCRTSRQNQKAMFEHLSFLLDNATMLLARPSLRGSVPLDVAYSSFMDNNELALALKEEELDKVAVYLSRCGLQPNSELITKGYPDIGWDPVEGERYIDFLRFCVWINGENVEENANLVIRLLIRRPECLGVALKGEGQGLFSAFKEAIALSEDIRLLENDSHPSLLSSGLLGENPTYPSKDAEGEDYIDLGAATLDFYSSLVDLLAKCAPDPMAIQAGKGDSLRARAILRSLISLDDLGQILALRFTIPNLAAPSIEDTGPLPGLLPNHKGSVLLFLDRVYGIDQQDMLFHVLEQSFLPDLRAATMMDSPRALESDTALALNRYLCNSVLPLLTNHSHFFADAEHHSALLDATLHTVYRMNRLKSLTKNQRDAVSDFLVAITRELPPAMMIKLLKKVITDILTMNDMNVLVPLRLITLHYERCGKYYGSGNHYGVASEQEKRLSMLLFDAIFDTLGSRPYDPELFGKALPCMTAIGSAISPDYTLTSGLEDVRNKRREEEGAWIPRTVDVSRCEINRDLEKMTELFAEHFHDSWASRKLEKGWVHGDLYSRANFTHPRLKPFALLKDFEKSFYKERCSECLKALMAWNYSFEMMDRDANDRASAARTLSGTSISNFAPKPIDLSSMTLEKDMVNAAEKMAEHSHLIWAKKVMNDLNTKGGFMPIPLVPWDLLTDFERRKDRFRASEILKFLQYHGYHVNCPKDEQSQNDRLKSEGERTSVEKRFAYNLLEKLITYLEQASLKMKSVKPSQELTRRNSFKKEGQDVKFFEKVVLPLMHAYFNAHKNYFLEGSSIVQTGTASNKEKEMVANLFCRLAALLRIKNRAFGSVAKITVKCLQGLTQALDLRTLVKVNSDIVRTSLLTFFNNCADDLYASVNELKDGGQYSLIRGQALKSWNSFEFANQMIVPVLTTMFAHLARNHFGTDLLLDDIQAACYKILDSLYMVTGLSSSISHRKSISGESEKHRPGLGQCLAAFASCFPVAFLEPEFNKSNKFSVLAKSQDQSVQVQEMLQNLSTHIPHLEKLLTDLETVANNNTMYSDVPNVYDVDLPLMCSYMAHWFSVGPDGKRDKEDQRASVVQTTSVSCDHINRIFNALLKMIRNHVGIENAPWLCRVNFFAVQIIQNVTSDPVREFVLPIAERLRRMSEKAYKEEEHMRTHPDDADEGTVAEDNARLVRDTYAFFPILMKYTDLHRAQWLKTPTWETDGVYENVAVIFRIWSQSQHFKREELNYVAQFEEDAAATGGGDMKTGKAAIAERKKKRREGQIKKDKHAASIVIACLKRLLPVGLNVFGGRELDIVQQSKEKFIQKETEEKIREFIKGLLEIPVKTDPTDKNAWQLSLYRKIGKSQMRGKDEMSQDAVIEKIFNMGQVSAILHTMTSRMEKEDIWKKVLTLQRKRMAISLITASHLYKTELHRGINFFLPAFSRLWMEEEDAGQDQLIADICSGVEEEEGPRIEIIMEEGVPIVASSEDTKEKETNPDPLKQLIRCFQRAATSEETAASAIHEDSLYIRFADVMAKSIHIEEEDGEDGEEGEIDQAAKEEQSQALRGEQAVLASRGAAIMCLMYLSASGGEPNEMVAQTLQLGIHLLSGGNVEIQKMLIEYLQLKKDVRFFTSMAGLMNKCSVLNLEMFERQIKAEGLGMGAELASGDNQNLNDADFTCSLFRFLQLTCEGHNLEFQNYLRTQPGHTTSVNLINCTVDYLLRLQESVMDFYWHYSSKEVIDEGGKEYFLRAIQVCSQVFNTLTESIQGPCVGNQMTLANSRLWDAINGFFFLFAHMMEKLYKNSTQLELLREFLNLQKDMIVLMLSMLEGNVLNGSIGKQMVDALVESQPSVEKILKFSDMFLKLKDLTTSQAFQDFDTNQDGWISPKEFQRAMESQKMYTVEDITYLMMCTDVNNDGKVDYMEFTERFHNPARDIGFNLAVLLVNLKEHITNDPRLEKIIEKAQTLLEYFDPFLGRIEIMGSSKRVEKIYFEIQESWLEQWGKQQIRDSKNSFLFNVLQDDGGDQGKLEAFINFCEDTIFEMQHAAAISSGDSDTKMERAIKQRDYFLQQTSADHISETFKSGYNYGISAASALSPQNISTTMRNVSSSVRQMSWTQLLYAVIILFIRAGLAIGWAGYLLLMTIFRFGYFLTTSSEEEEAARQEKEQAKMNNEHPSFNPPIIQEFHHSHVGVTAFGVGMNADHLNVNSLPDFVPPERPETPETVLEEEKPLNQETSPPTSPTSPASKAPSIYESIGAPQMVQLQSEADFQQGQYEPKIAESNSTKSRGSILNMLARNFKTIEKITLYLAFFINVILLFHRVDISHAENAEAASEGDDDEDALESIFITGMQFPYVEYEITGWMLAQILYWISVLHLSTSFALLVSFYQLKIPLITFKREKEIARKLMFDGCWITEEDSEELGIVDTFMWYLDRIVVSAKSFPMMYWDKFVRRKTRSKFKDQVDEETLTSILGEEKMSTDSSYDYRYSCWLWIGVILTNGQFLYRVGYLLCSACGVFLSPFFYAFHLIDVVLSFPMLKAILQSVTHNLQQLILTIMMTLVVVYLYTVIAFNFFRKFYVQEGEEGEEPDRKCHNMLTCFIYHFYAGVRAGGGIGDELESPYGDDLEYPRMFYDISFFFFVIIILLAIMQGLIIDAFGELRDQQESATEKLESSCFICDIGKETFDRMPRGFEIHTTKEHNFANYLFFLQHLVNKDETEYTGQETYVREKYDNRDWDFFPVGECFVKQYEDQLLQS

SEQ ID NO: 59 - protein, 5317 aa, Hemicentrotus pulcherrimus
MASQDAEDEVSFLRTGDQLNLVCSSQSLGHVLLGAEGFGNRNCVLEEASNQNVPPDLSICVFVLNQALSVRALQEMVITDQIDQGGQAGHRTLLYGHAMLLQHSLSSMHLACLPTSSSKDKLAFDVGLQESTQGEACWWTIHPVSKQRSEGEKVRVGDDLILVNVATERYLHLSVERDDQPMIVVASFQQTLWTVAPVSSGIVKIKAMAKKYGDTEKVLGFLNGLDTLRFSRGHMDEYLTVPPVGCKDDDNISEVSYDTGAVAQYARSLWRAELILKKWNGSYVSWGPPCRIRHLTSGKYLAVLENGTVCIVPRKSCNLDDTIFCFQQSREDLANYDSKQDHGMGSADIKYGDSTVLIQHMKTGHWLSYLVVESVVGGRAAERKVVMLPEGHMDDGFSVVRARAEESRSAGIIRKSTLLFNQFFDALDSLRGEKEDDQLAWNSFNLSSVVDILEDLIEYFGEPEEDEDHEEKQKKLKALRNRQDLFHEEGMVKLVLETIDKLSIFKSGRDFAAIVGEDAGDLWQDIVTYLYKLLAAMIRHNHNNCALFAQSVRLDWLINRLESQQASKGVLEVLHCVLLGSPEALNIIKENHIKSMISQLEKHGRDPKVLDVLCSLCVGNGVAVRSNQNLICDNLLPSRDLLLQTAVVDEVVCMRPNVSISVDKNSTVYKKWYFEVAIDKQEAGTSRPVHFRVGWATTQGFRTYLRGGEGWGNSGVVDDLYSFGFDGLNLWTGGVSKAAPWSGNRLLSKGDIVGVCFDLSVPRILYHVNGSPIKASFEGINLEGMFFPVLSFSARVCARFILGGKHGRFKYSPPKGFAAVCESVLPKERLKIEPCFALGHVTEGIIQGPTASQDHSAFIPAPVDTANVNLPGYIEMLRDKLAENIHELWCMNKIEAGWTWGPVRDDSKKVHDSLMFFSSLSEQEKNFDITMAYETLRTLMALGYHISIDEETSKSTLKRLRLPMNYLMSNGYKPAPYNLSTIHLNVKMEKLVELLAENAHNVWAKDRIAQGWTYGLSEETSYKRNPQLVPYNQLNDQAKKLNRDTASETIRTILGFGYALEPPTNEGQSDPSFRGLAREISDKKSHTRTFRAEKSYAVKSGRWYFEFEAMTTGYMRVGWGRPTIAARSEVGTDGCSFAFDGFLARKWHQGSETFGKTWGEMDVIGCMLNLVDNTISFTMNGEYLCDSVGSEMAFHDIEIGEGFVPVCMLAAGEKAHLHFGQDVNDLKYFTVCGLQEGYEPFCVNMKKSMPLWYSKSQPMFQSIEDEHDRLGITRIPAGIEGPPCLKVSHKKCGTVENLPTEYLRLSMPVVCKDFPTSGEMVLSIPVPVLSPGNKRGQWIQQGATSLDLSETDSNDGTNRRTRSGLDKMEHKAIDTDAIDGDARVNGYNGDTKELTKKEKKKLASLPLGRKIPMSRAASSETSTVQSPDSSFERSGPSPAKSKRSKFTKSSSMDSGAKHPEDTLAKPTGYEVDGQRSPGAARRGKKHDRLRTPEASPPGTLTREYIPLKSDNEGSVGSDNHGRPRLAKLVSMGSSFDVFSKSIDIMSDISEADSIDLSMMTKFYYSVRIFPGQDPTDIHVGWVTPGYHHYSPHFDPSKTSEVTVNMLGENGGVQESSKRRDCFTVCVGDHMDLLITPEGRRISSGLVVGCVVDACNGELYFTINGRDISTKYQVEPKTKLFPAVFVKPTSKEMLQFELGRSKILERRSSSVQSEIAQMSVNQNCLPLSAAWFRGDTHNPTPQCPSRVEVQVMYTNTWARAPLQTMNIETKKMSDNNGWLVSCPEPVSWLGVHIPEENRCMDILELVEHEDLLKFHAHTLRLYCSVCSHGNHHVAHALINHVNEDQLMYCLQCPYISGPLRIGYYNLLHALHLQTHVSARLKTQDEFIIPLMAGPKPVDEELDISSSMSIKRALSTTKSVSIRPQLNIGPSADSSHQSFSQSMKASEQAPPGFNHMVLKQHVISSLGEAVAHGVSHCRDPIGGNYNNLFVPLLELCDALLVIGEFDDDDLKSLLILIDPATFDETYKKGVSETVGMLQMHLDEPVKLAMCFLLQHLCDSQLRHRVESIINFSDDFVEECQADQLRRFLEVRNTDMPPVIAAKKTREFRSTPQEQMRMLLHFKDGDDGMCPCREDLRSVLLEFHSTLAKHCGVHETQEEKSTDSRGVIRRFLSWLSGSRKDASPAGAILQEKFSSDSLSHLISNTMIKWAEEKHIEDPTLVREMFNLLHRQYDGVGELCSALQKSYVVSSNQRDDIVHLLTSLGQIRSLLTVQMGSVEEEALIKHLWEVTDNKVFYQHPDLMRALCVHETVMNVMVNVLEKHQTSIQLTSDEEAESSAQGQGVTGASTAAAPPKTQVCVYRFLARRARMCHSKDRFARALIAGCCRFLCYFCRTSRQNQRALFDTLLYLLDHGFIGLSYPSLRGSCPLDVAAASLMDNNELALALREQHLEKVITFLSRCGVQDNARLRAMGNPYLDGTPLDGERYLDFMRHAVWVNGETVEENANLIVRMLIRHPECLGPALRGEGKGLLAAMEEAIDLSETAEEGYLISAPTMAISEEDGEVRPIDASGQDEEGDEDEDDVDTGGAILTFYATLIDLLGRCAPDENRLSQGRTEPQRIRAILQSLVPLDDLVGVLNLKFILPSPQKIYEKKDDGAGKPLGADLKGLTPVHKEAMLLFLERVYGVGNQELFFELLEVGFLPDLRAATTMDTPTTHDHDMALALNRYICNSVLPLLTRHSEMFESADQFASLLDSTLHTVYRLASCRSLTRGQRDTVADFLVALTRSLKPSMMQRLLRKLINDVPVLAEYSYVALKILQLHYERCVSYYGSNGGWGSYGAANDEEKRLTMMLFTGLFDALAEKEYDEELFDRALPCLTAIGSALPPDYSMSYNDESYVRESCFDADGIYQPKPVDSNKVLLNESLLSFSDRFAEHLHDSWALAMFDNGWTHGEAENSAMKESCMLRPYKTLTTKEKDSYREPVRECIKALLAWGWSVERSKASEQQSQAHRPRRLSKASLGAMESPHGYNPRPIDVSNITLTREMQTMAERLAENAHDVWAKKTKLEMELRGSGCHAQLVPFDILTDSEKKKDRDMAQALLKFLQVNGYRLQRHSLSMDADGIIRGHSTIEKRFAFNLLDKLLHYVDKSQANLKPQRRQQDSFRSSKKESSGDRGYKFFAKVVLPLIEKYFQAHSSYFVADPNAPQNGRSGGASTREKELVSSLFCKLAQLIRQKINLFGRDLVPFIRCIRVVAQSIDASSVVKHSADAIKNGLLVFFRHASDDLVATVDSVTSGGRFTHIKSNQVHKHSLAVNYVPGVLVPVLISLFQHLARHNYGADLLLDQIQVYCYRILSCLYKVGADQSIYVKKLRPAVGELLAAFSGAFPVAFLEPHLNKNNPNSLLGQIELRGATVEGKEELIKLAAGIPTLPAVVTEIDKMAMSGAKYDQAPHIIEVILPMLCSYLNYWWQQGPDNICRRQGNYWTMVNSGNLNNTLGNVLTLVKNNLGSENAPWMSRIAATAKPILNDAQPELLKTHFVPVIEKLEERTSKVFKAEEDLKKEYPMGGQEMEETEFAILEDYHLIIRDLYASYPLLIKFVDSQRSQWLKSPSIDAEKLYYKVASIFNSWARSANFRREEQNYVAQTEVDSSAALTSAMSKSGGGNGNFSYGGSLPGEPPKLQSTAPKRPDGQHGSPPSLILAALKRLLPIGMNQYGAREQELVQQAKLMFGQKETDKEVRDYLLQQLHLHEKEKVEETARLTALGHAQSSISPKPSVSFSSSPPSSSSPASAPALATSSSSATSTTSTSSSSSSSSSSSSPSSPPSSSVDPQDSTKPSRIRTRRQSIAAWQTAASRVTGAHITQSDSKGWQRHLYNNMAASKLVQVVELTKDKVIERIMNMAQVLNRLHQMEHPSMSKKNAWRRLMSAQRKRAIMACFRMIPLHHLPRHRAINFFLKAYKERWLSNEESAQHLLIDDLTKCSSEELQEFEPENVKDPLYQLISTFSRAFGLQQDMLEEDPLYLSYAAIMSTSCSGGEDDDDDDDGGDENGTSFQEQEMEKQKLLSEQARLAERGCAEMVLLLISASKGEPSDMVFCSLKLGISLLRGGNEMVQRKMLEHLQDKMDVGFFTSVAELMEKCTVLDLEAFERYNKAEGLGVTSGENAGCDGLRAGEKAMHDAEFTCALFRFLQLLCEGHNLEFQNYLRTQAGNHTTVNIIICTVDYLLRLQESISDFYWHYSGKDVVDAQGRENFSRAFKVVKQVFSSLTEYIQGPCSGNQLALAHSRLWDAVVGFLHIFANLQKKLSQDTSQLELLRDLLNLHKEMVVMLLSMLEGNVMHGTTGKQMVDTLVESSSNLEMILKFFDMFLKLKDLSSSDAFREFDANGDGWISHKEFQKAMEAQKMYTVDEIDYLLKCADRNNDGRIDFNEFTERFHGPAQDIGFNLAVLLTNLNDHMPGERRLERFLLQAESLLTYFEPYLGRIEIMGSSRGIERVYFKITESHKAQWEKPQIKESKQQFLHEVVNEGGEKEKLEDFVNFCEDTIFEMQHATSISDTGESLPEVFMSLLTFGASRDSNNWLVWLVRGMRPSNICRLMGDFFSSSQYNIKQIRSLSLFRLFFGVIKLIFLGVFKLFKFAFVIVGKLIGLLVGTRILEDAREITGSIKHSLHVPRVARRQTSSIINVPGYGMPSARRNTSFWQYLTSQYFTNVNSMDTVSAFGIDFLKGKGGGGGGGAGGTDQYKLRMRRKRRPLTPSSSFDFDEEMSMDNMPTHTPSEASDSSFDSGAMAKNDFSMPDMSAGRRDSTVFPSLFLATEMPSTQVKEEEEEEEPVYEPQMNRVKQTVVSLFARNFYNIKYVALALVFCINILLLFFKVSYLTAELEEVDPYHPVEILENATSPNGADMAGDEDRVDDQIEQILINQQFMYLVPVLQVLSILHSLVSISMLIAYCALKVPLCLFKREKEIARKLEFDGQWITEQPTRDDIKGQWDSLAISTVSFPVYYWDKFVKKKVLKKYEDAVGEDKLCAMLGMEIGENPMAGNPTENPNQGLFSSMLTSLDWKYHIWKCGVIGTDNSFLYIAWYLLFSLLGHINPFFFAAHLLDIAMGFKTLRTVLQSVTHNGKQLVLTLMMTCVIIYLYTVLAFNFFRKFYTKDDEGEIEYKCHNMMSCFVFHLHSGLRAGGGIADEIEAPDGDVYEYYRIIFDITFFFFVIVILLAIIQGLIIDAFGELRDQLEQVREDMETKCFICSIGREYFDKLPHGFELHTSKEHDLSNYMFFLMYLINKPETEHTGQESYVWQLYQQRCWDFFPVGDCFRKQYDDEQA

SEQ ID NO: 60 - protein, 4967 aa, Mus musculus
MADAGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNSSWHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFAFRSSKEKLDVGVRKEVDGMGTSEIKYGDSICYIQHVDTGLWLTYQAVDVKSARMGSIQRKAIMHHEGHMDDGLNLSRSQHEESRTARVIRSTVFLFNRFIRGLDALSKKVKLPTIDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAACYEAVLPKEKLKVEHSREYKQERTYTRDLLGPTVSLTQAAFTPVPVDTSQIVLPPHLERIRERLAENIHELWVMNKIELGWQYGPVRDDNKRQHPCLVEFCKLPEQERNYNLQMSLETLKTLLALGCHVGIADEHAEEKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYHLEAPDQDHASRAEVCSGTGERFRIFRAEKTYAVKAGRWYFEFEAVTAGDMRVGWSRPGCQPDLELGSDDRAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNNNTDIMFYRLSMPIECAEVFSKSVAGGLPGAGFYGPKSDLEDFDVDSDFEVLMKTAHGHLVPDRIDKDKETPKPEFNNHKDYAQEKPSRLKQRFLLRRTKPDYSTGHSARLTEDVLAGDRDDYEYLMQTSTYYYSVRIFPGQEPANVWVGWITSDFHQYDTGFDLDRVRTVTVTLGDEKGKVHESIKRSNCYMVCAGESMSPGQGRNNSNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLQFHYHTLRLYSAVCALGNHRVAHALCSHVDEPQLLYAIENKYMPGLLRAGYYDLLIDIHLSSYATARLMMNNEFIVPMTEETKSITLFPDENKKHGLPGIGLSTSLRPRMRFSSPSFVSISNDCYQYSPEFPLDILKAKTIQMLTEAVKEGSLHARDPVGGTTEFLFVPLIKLFYTLLIMGIFHNEDLKHILQLIEPSVFKEAAVPEEEGGTPEKEISIEDAKLEGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGSNDLTIRGRLLSLVEKVTYLKKKQAEKPVASDSRKCSSLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVARYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPTSGSSKTLDIEEEEDDTIHMGNAIMTFYAALIDLLGRCAPEMHLIHAGKGEAIRIRSILRSLIPLGDLVGVISIAFQMPTIAKDGKVVEPDMSAGFCPDHKAAMVLFLDRVYGIEVQDFLLHLLEVGFLPDLRAAASLDTAALSATDMALALNRYLCTAVLPLLTRCARLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKIQPLMKPYKLLSEKEKEIYRWPIKESLKTMLAWGWRIERTREGDSMALYNRTRRISQTSQVSIDAAHGYSPRAIDMSNVTLSRDLHAMAEMMAENYHNIWAKKKKLELESKGGGNHPLLVPYDTLTAKEKAKDREKAQDIFKFLQISGYVVSRGFKDLDLDTPSIEKRFAYSFLQQLIRYVDEAHQYILEFDGGSRSKGEHFPYEQEIKFFAKVVLPLIDQYFKNHRLYFLSAASRPLCTGGHASNKEKEMVTSLFCKLGVLVRHRISLFGNDATSIVNCLHILGQTLDARTVMKTGLDSVKSALRAFLDNAAEDLEKTMENLKQGQFTHTRSQPKGVTQIINYTTVALLPMLSSLFEHIGQHQFGEDLILEDVQVSCYRILTSLYALGTSKSIYVERQRSALGECLAAFAGAFPIAFLETHLDKHNVYSIYNTRSSRERTALSLPANVEDVCPNIPSLEKLMTEIIELAESGIRYTQMPYMMEVVLPMLCSYMSRWWEHGPENHPERAEMCCTALNSEHMNTLLGNILKIIYNNLGIDEGAWMKRLAVFSQPIINKVKPQLLKTHFLPLMEKLKKKAAMVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAISDQERKKMKRKGDRYSMQTSLIVAALKRLLPIGLNICAPGDQELIALAKNRFSLKDTEEEVRDIIRSNIHLQGKLEDPAIRWQMALYKDFPNRTEDPSDPERTVERVLGIANVLFHLEQKSKYTGRGYFSLVEHPQRSKKAVWHKLLSKQRKRAVVACFRMAPLYNLPRHRAVNLFLQGYEKSWIETEEHYFEDKLIEDLAKPGAELPEEDEAMKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDIIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERLANKEESEKERPEEQAPRMGFFSLLTIQSALFALRYNVLTLVRMLSLKSLKKQMKRMKKMTVKDMVLAFFSSYWSVFVTLLHFVASVCRGFFRIVSSLLLGGSLVEGAKKIKVAELLANMPDPTQDEVRGDEEEGERKPLESALPSEDLTDLKELTEESDLLSDIFGLDLKREGGQYKLIPHNPNAGLSDLMTNPVPVPEVQEKFQEQKAKEEKEEKEETKSEPEKAEGEDGEKEEKAKDEKSKQKLRQLHTHRYGEPEVPESAFWKKIIAYQQKLLNYFARNFYNMRMLALFVAFAINFILLFYKVSTSSVVEGKELPTRTSSDTAKVTNSLDSSPHRIIAVHYVLEESSGYMEPTLRILAILHTIISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 61 - protein, 4968 aa, Oryctolagus cuniculus
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDGGVRKEVDGMGTSEIKYGDSICYIQHVDTGLWLTYQSVDVKSVRMGSIQRKAIMHHEGHMDDGLNLSRSQHEESRTARVIRSTVFLFNRFIRGLDALSKKAKASSVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEEKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFEAVTSGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVPGGLPGAGLFGPKNDLEDYDADSDFEVLMKTAHGHLVPDRVDKDKETTKAEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRTGYYDLLIDIHLSSYATARLMMNNEFIVPMTEETKSITLFPDENKKHGLPGIGLSTSLRPRMQFSSPSFVSINNECYQYSPEFPLDILKAKTIQMLTEAVKEGSLHARDPVGGTTEFLFVPLIKLFYTLLIMGIFHNEDLRHILQLIEPSVFKDAATPEEEGDTLEEEPSVEDTKLEGAGEEEAKMGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQTEKPVESDSRKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPTSGSSKTLDTEEEEDDTIHMGNAIMTFYAALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNIIIPEKLEYFINKYAEHSHDKWSMDKLANGWIYGEIYSDSSKIQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKLELESKGGGNHPLLVPYDTLTAKEKAKDREKAQDILKFLQINGYAVSRGFKDLELDTPSIEKRFAYSFLQQLIRYVDEAHQYILEFDGGSRSKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPRGVTQIINYTTVALLPMLSSLFEHIGQHQFGEDLILEDVQVSCYRILTSLYALGTSKSIYVERQRSALGECLAAFAGAFPVAFLETHLNKHNIYSIYNTKSSRERAALSLPANVEDVCPNIPSLEKLMEEIVELAESGIRYTQMPHVMEVILPMLCSYMSRWWEHGPESNPGRAEMCCTALNSEHMNTLLGNILKIIYNNLGIDEGAWMKRLAVFSQPIINKVKPQLLKTHFLPLMEKLKKKAAMVVSEEDHLKAEARGDMSEAELLILDEFTTLARDLYAFYPLLIRFVDYNRAKWLKEPTPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRNNIHLQGKLEDPAIRWQMALYKDLPNRTEETSDPEKTVERVLDIANVLFHLEQKSKFIGRRYYNLVEHPQRSKKAVWHKLLSKQRKRAVVACFRMAPLYNLPRHRAVNLFLQGYEKSWIETEEHYFEDKLIEDLAKPGAEPPEEDEVTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGIISKRDFHKAMESHKHYTQSETEFLLSCAETDENETLDYEEFVKRFHEPAKDIGFNVAVLLTNLSEHMPNETRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPKMGFFSVLTVRSALFALRYNILTLMRMLSLKSLKKQMKKMKKMTVKDMVTAFFSSYWSIFMTLLHFVASVFRGFFRIVCSLLLGGSLVEGAKKIKVAELLANMPDPTQDEVRGDGEEGERKPMETTLPSEDLTDLKELTEESDLLSDIFGLDLKREGGQYKLIPHNPNAGLSDLMSNPVLIPEEQEKFQEQKTKEEEKEEKEETKSEPEKAEGEDGEKEEKVKEDKGKQKLRQLHTHRYGEPEVPESAFWKKIIAYQQKLLNYFARNFYNMRMLALFVAFAINFILLFYKVSTSSVVEGKELPSRSTSENAKVTTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSILGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 62 - protein, 4967 aa, Homo sapiens
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTPLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLARTMRTERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 63 - protein, 57 aa, Artificial Sequence
  UNSURE (16)..(16): Xaa = any amino acid
  UNSURE (22)..(22): Xaa = any amino acid
  UNSURE (31)..(31): Xaa = any amino acid
  UNSURE (37)..(37): Xaa = any amino acid
SCTATGERVCLAAEGXGNRHCXLENIADKNXPPDLSXCVFVIEQALSVRALQELVTA

SEQ ID NO: 64 - protein, 28 aa, Artificial Sequence
  UNSURE (14)..(14): Xaa = any amino acid
  UNSURE (23)..(23): Xaa = any amino acid
RTLLYGNAILLRHXNSDMYLACXSTSSS

SEQ ID NO: 65 - protein, 48 aa, Artificial Sequence
VNASFHVTHWSVQPYGTGISRMKYVGYVFGGDVLRFFHGGDECLTIPS

SEQ ID NO: 66 - protein, 30 aa, Artificial Sequence
  UNSURE (16)..(16): Xaa = any amino acid
  UNSURE (23)..(23): Xaa = any amino acid
QARSLWRLELARTKWXGGFINWXHPMRIRH

SEQ ID NO: 67 - protein, 18 aa, Artificial Sequence
  UNSURE (8)..(8): Xaa = any amino acid
  UNSURE (11)..(11): Xaa = any amino acid
LEDKDLEXIGXPIIKYGD

SEQ ID NO: 68 - protein, 29 aa, Artificial Sequence
  UNSURE (20)..(20): Xaa = any amino acid
YKSYETKKKGVGKVEEKQAXLHEEGKMDD

SEQ ID NO: 69 - protein, 22 aa, Artificial Sequence
  UNSURE (9)..(9): Xaa = any amino acid
SRSQEEESXTARVIRKCSSLFT

SEQ ID NO: 70 - protein, 36 aa, Artificial Sequence
  UNSURE (10)..(10): Xaa = any amino acid
  UNSURE (11)..(11): Xaa = any amino acid
  UNSURE (26)..(26): Xaa = any amino acid
DMEHEEKQNXXRALRNRQDLFQEEGXLNLILEAIDK

SEQ ID NO: 71 - protein, 22 aa, Artificial Sequence
YLYQLLAAIIKGNHTNCAQFAN

SEQ ID NO: 72 - protein, 65 aa, Artificial Sequence
  UNSURE (9)..(9): Xaa = any amino acid
  UNSURE (21)..(21): Xaa = any amino acid
GMLDVLHCXLIDSPEALNMMXDEHIKVIISLLEKHGRDPKVLDVLCSLCVGNGVAVRSSQNNICD

SEQ ID NO: 73 - protein, 19 aa, Artificial Sequence
  UNSURE (10)..(10): Xaa = any amino acid
GYVPYPGGGXKWGGNGVGD

SEQ ID NO: 74 - protein, 19 aa, Artificial Sequence
  UNSURE (12)..(12): Xaa = any amino acid
KLAENIHEMWAXNKIEAGW

SEQ ID NO: 75 - protein, 16 aa, Artificial Sequence
  UNSURE (7)..(7): Xaa = any amino acid
AEKRYDXQLAVQTLKT

SEQ ID NO: 76 - protein, 21 aa, Artificial Sequence
  UNSURE (8)..(8): Xaa = any amino acid
NTHNLWAXERIQQGWTYGLNE

SEQ ID NO: 77 - protein, 26 aa, Artificial Sequence
  UNSURE (9)..(9): Xaa = any amino acid
  UNSURE (13)..(13): Xaa = any amino acid
RSPHLVPYXKVDXAIKKANRDTASET

SEQ ID NO: 78 - protein, 12 aa, Artificial Sequence
  UNSURE (6)..(6): Xaa = any amino acid
WYTKDXPIFENT

SEQ ID NO: 79 - protein, 15 aa, Artificial Sequence
  UNSURE (4)..(4): Xaa = any amino acid
VEAXSKEILQIELGR

SEQ ID NO: 80 - protein, 19 aa, Artificial Sequence
  UNSURE (10)..(10): Xaa = any amino acid
PPRLKVQCLXPHQWARVPN

SEQ ID NO: 81 - protein, 18 aa, Artificial Sequence
  UNSURE (10)..(10): Xaa = any amino acid
ALHIPEEDRXIDILELIE

SEQ ID NO: 82 - protein, 24 aa, Artificial Sequence
  UNSURE (9)..(9): Xaa = any amino acid
DEHRKGLLXMKMAEGAKLQMCYLL

SEQ ID NO: 83 - protein, 28 aa, Artificial Sequence
  UNSURE (11)..(11): Xaa = any amino acid
  UNSURE (17)..(17): Xaa = any amino acid
EIKQSDLPSAXAAKKTXEFRCPPREQMN

SEQ ID NO: 84 - protein, 42 aa, Artificial Sequence
  UNSURE (7)..(7): Xaa = any amino acid
  UNSURE (19)..(19): Xaa = any amino acid
  UNSURE (23)..(23): Xaa = any amino acid
  UNSURE (32)..(32): Xaa = any amino acid
GLSQIRXLLPVQMSQEEEXLMRXRLWKLVNNXTFFQHPDLIR

SEQ ID NO: 85 - protein, 35 aa, Artificial Sequence
  UNSURE (8)..(8): Xaa = any amino acid
  UNSURE (24)..(24): Xaa = any amino acid
  UNSURE (26)..(26): Xaa = any amino acid
KEKDTSHXMVVACCRFLCYFCRTXRXNQKAMFDHF

SEQ ID NO: 86 - protein, 50 aa, Artificial Sequence
  UNSURE (37)..(37): Xaa = any amino acid
RPSLRGSTPLDVAYSSLMENTELALALREHYLEKIAXYLSRCGLQSNSEL

SEQ ID NO: 87 - protein, 59 aa, Artificial Sequence
  UNSURE (21)..(21): Xaa = any amino acid
  UNSURE (46)..(46): Xaa = any amino acid
GYPDLGWDPVEGERYLDFLRXCVWVNGESVEENANLVIRLLIRRPXCLGPALRGEGEGL

SEQ ID NO: 88 - protein, 24 aa, Artificial Sequence
  UNSURE (13)..(13): Xaa = any amino acid
DEDYIDTGAAILXFYCTLVDLLGR

SEQ ID NO: 89 - protein, 21 aa, Artificial Sequence
GKNESLRARAILRSLVPLEDL

SEQ ID NO: 90 - protein, 35 aa, Artificial Sequence
  UNSURE (12)..(12): Xaa = any amino acid
LLDATLHTVYRXSKNRMLTKGQREAVSDFLVALTS

SEQ ID NO: 91 - protein, 30 aa, Artificial Sequence
  UNSURE (11)..(11): Xaa = any amino acid
  UNSURE (15)..(15): Xaa = any amino acid
MLLKLLRKLTXDVSXLSEYTTVALRLLTLH

SEQ ID NO: 92 - protein, 12 aa, Artificial Sequence
GASSDEEKRLTM

SEQ ID NO: 93 - protein, 22 aa, Artificial Sequence
  UNSURE (12)..(12): Xaa = any amino acid
PELFGKALPCLXAIGCALPPDY

SEQ ID NO: 94 - protein, 26 aa, Artificial Sequence
  UNSURE (14)..(14): Xaa = any amino acid
QLVPYDLLTDKEKXKDRERSQEFLKY

SEQ ID NO: 95 - protein, 12 aa, Artificial Sequence
GAASLKEKEMVA

SEQ ID NO: 96 - protein, 15 aa, Artificial Sequence
KNCPEFIRTSMLTFF

SEQ ID NO: 97 - protein, 14 aa, Artificial Sequence
  UNSURE (9)..(9): Xaa = any amino acid
YTQQIIINXSEELL

SEQ ID NO: 98 - protein, 17 aa, Artificial Sequence
  UNSURE (11)..(11): Xaa = any amino acid
FYPLLIKYVDXQRNHWL

SEQ ID NO: 99 - protein, 33 aa, Artificial Sequence
  UNSURE (9)..(9): Xaa = any amino acid
  UNSURE (24)..(24): Xaa = any amino acid
WSKSQYFLXEEQNFISANEIDNMXLIMPTATRR

SEQ ID NO: 100 - protein, 32 aa, Artificial Sequence
  UNSURE (21)..(21): Xaa = any amino acid
SLMVACLKRLLPVGLNLFAGXEQELVQHCKDR

SEQ ID NO: 101 - protein, 12 aa, Artificial Sequence
DEMSWQHYLYSK

SEQ ID NO: 102 - protein, 19 aa, Artificial Sequence
  UNSURE (7)..(7): Xaa = any amino acid
YRSVVSXQRKRAVIACFRQ

SEQ ID NO: 103 - protein, 22 aa, Artificial Sequence
  UNSURE (16)..(16): Xaa = any amino acid
CRGAMTERSGALQEDXLYMSYA

SEQ ID NO: 104 - protein, 18 aa, Artificial Sequence
SIHEQEMEKQKLLFHQAR

SEQ ID NO: 105 - protein, 13 aa, Artificial Sequence
RGVAEMVLLHISA

SEQ ID NO: 106 - protein, 48 aa, Artificial Sequence
  UNSURE (11)..(11): Xaa = any amino acid
  UNSURE (21)..(21): Xaa = any amino acid
IQMGMLNHLKXKKDVGFFTSXAGLMNSCSVLDLDAFERNTKAEGLGVG

SEQ ID NO: 107 - protein, 30 aa, Artificial Sequence
  UNSURE (16)..(16): Xaa = any amino acid
GAAGEKNMHDAEFTCXLFRFIQLTCEGHNL

SEQ ID NO: 108 - protein, 53 aa, Artificial Sequence
  UNSURE (14)..(14): Xaa = any amino acid
  UNSURE (40)..(40): Xaa = any amino acid
LRTQAGNTTTVNVXICTVDYLLRLQESIMDFYWHYSSKEXIDPAGKANFFKAI

SEQ ID NO: 109 - protein, 93 aa, Artificial Sequence
  UNSURE (9)..(9): Xaa = any amino acid
  UNSURE (44)..(44): Xaa = any amino acid
  UNSURE (66)..(66): Xaa = any amino acid
  UNSURE (75)..(75): Xaa = any amino acid
NQQALAHSXLWDAVGGFLFLFSHMQDKLSKHSSQVDLLKELLNXQKDMITMMLSMLEGNVVNGTIXKQMVDTLVXSASNVELILKYFDMFLKL

SEQ ID NO: 110 - protein, 24 aa, Artificial Sequence
KEIGFNLAVLLTNLSEHMPNEPRL

SEQ ID NO: 111 - protein, 19 aa, Artificial Sequence
  UNSURE (13)..(14): Xaa = any amino acid
SKRIERVYFEIKXXNIEQW

SEQ ID NO: 112 - protein, 34 aa, Artificial Sequence
  UNSURE (17)..(17): Xaa = any amino acid
ESKRAFFYSIVTEGGDXEKLEAFVNFCEDAIFEM

SEQ ID NO: 113 - protein, 17 aa, Artificial Sequence
LARNFYNLKYVALVLAF

SEQ ID NO: 114 - protein, 19 aa, Artificial Sequence
YYHLKVPLAIFKREKEIAR

SEQ ID NO: 115 - protein, 50 aa, Artificial Sequence
  UNSURE (8)..(8): Xaa = any amino acid
  UNSURE (21)..(21): Xaa = any amino acid
  UNSURE (31)..(31): Xaa = any amino acid
  UNSURE (37)..(37): Xaa = any amino acid
EQPEDDDXKSHWDKLVISAKXFPVNYWDKFXKKKVRXKYSETYDFDSISN

SEQ ID NO: 116 - protein, 57 aa, Artificial Sequence
  UNSURE (36)..(36): Xaa = any amino acid
FFFAAHLLDVAVGFKTLRTILQSVTHNGKQLVLTVXLLTIIVYIYTVIAFNFFRKFY

SEQ ID NO: 117 - protein, 25 aa, Artificial Sequence
  UNSURE (11)..(11): Xaa = any amino acid
CHDMLTCFVFXLYKGVRAGGGIGDE

SEQ ID NO: 118 - protein, 25 aa, Artificial Sequence
ILLAIIQGLIIDAFGELRDQLESVK

SEQ ID NO: 119 - protein, 33 aa, Artificial Sequence
EHNLANYMFFLMHLINKPDTEYTGQETYVWNMY

SEQ ID NO: 120 - protein, 5127 aa, Drosophila melanogaster
  gi 17352465
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFCLRQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETVRTLLVYGYVLDPPTGEGTEALLAEAQRLKFAGFRTYRVERNYAVTSGKWYFEFEVLTSGPMRVGWARADCYPGAMLGSEDTSWAFDGHNVTKMHAGSIEHFGVRYEAGDVIGCFIDVKEQTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITPPVIATSSMPSVSSEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTLGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARAILRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVALNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNLQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILAEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLTEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 121 - protein, 5113 aa, Drosophila melanogaster
  gi 17352467
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFCLRQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETVRTLLVYGYVLDPPTGEGTEALLAEAQRLKFAGFRTYRVERNYAVTSGKWYFEFEVLTSGPMRVGWARADCYPGAMLGSEDTSWAFDGHNVTKMHAGSIEHFGVRYEAGDVIGCFIDVKEQTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTLGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARAILRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVALNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNLQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILAEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLTEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 122 - protein, 5127 aa, Drosophila melanogaster
  gi 17352469
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFCLRQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETVRTLLVYGYVLDPPTGEGTEALLAEAQRLKFAGFRTYRVERNYAVTSGKWYFEFEVLTSGPMRVGWARADCYPGAMLGSEDTSWAFDGHNEEKVYGGVSESFGKQCGPGDIVGVFLDLADHTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITPPVIATSSMPSVSSEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTLGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARAILRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVALNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNLQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILAEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLTEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 123 - protein, 5126 aa, Drosophila melanogaster
  gi 2160475
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFSWQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETSANAPGLRICLGSSDGRRNGGTSGRGTTPQVRRIPTYRVERNYAVTSGKWYFEFEVLTSGPMRVGWARADCYPGAMLGSEDTSWAFDGHNVTKMHAGSIEHFGVRYEAGDVIGCFIDVKEQTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITPPVIATSSMPSVSSEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTIGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARASLRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVPLNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNQQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILGEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLIEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 124 - protein, 5126 aa, Drosophila melanogaster; identical to SEQ ID NO: 56
  gi 2160476

SEQ ID NO: 125 - protein, 5112 aa, Drosophila melanogaster
  gi 2160477
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFSWQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETSANAPGLRICLGSSDGRRNGGTSGRGTTPQVRRIPTYRVERNYAVTSGKWYFEFEVLTSGPMRVGWARADCYPGAMLGSEDTSWAFDGHNEEKVYGGVSESFGKQCGPGDIVGVFLDLADHTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTIGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARASLRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVPLNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNQQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILGEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLIEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 126 - protein, 5112 aa, Drosophila melanogaster
  gi 2160478
MAEAEGGSEQDDVSFLRTEDMVTLSCTATGERVCLAAEGFGNRHCFLENIADKNVPPDLSQCVFVIEQALSVRALQELVTAAGSETGKGTGSGHRTLLYGNAILLRHHNSDMYLACLSTSSSNDKLSFDVGLQEHSQGEACWWTVHPASKQRSEGEKVRVGDDLILVSVATERYLHTTKENEQSIVNASFHVTHWSVQPYGTGISRMKYVGYVFGGDVLRFFHGGDECLTIPSTWGREAGQNIVIYEGGVVMAQARSLWRLELARTKWTGGFINWYHPMRIRHITTGRYLGVNDSNELILVKKEEASIATTTFSWQEKDDEKKVLEDKDLEVIGSPIIKYGDTTVIVQHCETSLWLSYKSYETKKKGVGKVEEKQAILHEEGKMDDCLDFSRSQEEESKTARVIRKCSSLFTQFITALETLQSNRRHSIFFQKVNLNEMVMCLEDLINYFSQPEDDMEHEEKQNRFRALRNRQDLFQEEGVLNLILEAIDKINIITSQGFLASFLAGDETGQSWDLISTYLYQLLAAIIKGNHTNCAQFANSNRLNWLFSRLGSQASSEGSGMLDVLHCVLIDSPEALNMMRDEHIKVIISLLEKHGRDPKVLDVLCSLCVGNGVAVRSSQNNICDFLLPGKNLLLQTLLVDHVASIRPNIFVGRVDGSSMYQKWYFEVTMDHIEQTTHMMPHLRIGWANTSGYVPYPGGGKKWGGNGVGDDLYSFGFDGAFLWTGGRKTLVVDALPEEPFIRKGDVIGVAIDLSVPIITFTFNGVKVRGSFRDFNLDGMFFPVMSCSSKLSCRFLFGGDHGRLKFAPPMGFSALVQCLMPQQILSLDPCFYFGNLAKNVLAGPWLIEDDTAFVPKPVDTTGVTLPSSVDQIKEKLAENIHEMWALNKIEAGWSWGEHRDDYHRIHPCLTHFEKLPAAEKRYDNQLAVQTLKTIISLGYYITMDKPPARIRPVRLPNEIFMQGNGYKPAPLDLSAVTLTPKLEELVDQLAENTHNLWARERIQQGWTYGLNEDSENHRSPHLVPYAKVDEAIKKANRDTASETSANAPGLRICLGSSDGRRNGGTSGRGTTPQVRRIPTYRVERNYAVTSGKWYFEFEVLTSGPMRVGWARADCYPGAMLGSEDTSWAFDGHNVTKMHAGSIEHFGVRYEAGDVIGCFIDVKEQTISFSLNGELLMDALGGETTFADVTAEGVGFVPACTLGVGQKARLIYGQDVDSLKFFTTCGLQEGYEPFCVNMRRPVTHWYTKDQPIFENTEEMPDCRIDVTRIPGGADTPPHLKISHNTFETMEKANWEFLRLSLPVTCMGEFISEQEKARRWDEIKNRQYRLMREAEIAAQMQVQTQAAHMDHMLKGGFNMNDIKGLTRNFDEHADAEADHMMRGPNRPPRKGSLTRNITFETDMSAALDEMQRSTSVLDMNGLGEEMDDKKKRGRSPFKFFSKKSRDQSREKMGARTLDTSLERRNTVAHGRNVVNQQMTTRAPTLRLNNAEIPPSPVPQGPKQLSGSNLGQQPVETSGDEMFDAECLKLINEYFYGVRIFPGQDPTHVYVGWVTTQYHLHSREFNKNKVRRGSVYIEDDYEMAIERIDRQSCYVVRADELFNEVTQDASGKGASQGMFVGCFVDTATGIIRFTCEGKDTSHRWMMEPDTKLFPAIFVEATSKEILQIELGRTPTTLPLSAAVLPTSDKHINPQSPPRLKVQCLRPHQWARVPNTALQVHALKLSDVRGWSMLCEDPVSMLALHIPEEDRCIDILELIEMDKLLSFHAHSLTLYAALCYQSNYRAAHALCQHVDQKQLLYAIRSEYMSGPLRQGFYDLLIALHLESHATTMEVCKNEYITPLGAELKELYSDEEMQHSLRSLVTESVRPQLRMTEITEPIPDIDQLYSPKFPLEVVRQFVMEALKDAVEINQVHNRDPIGWTNENLFLPLIKLTDRLLLVGVLTDEDVQRLLVMIDPETWDQAFEREGKDEHRKGLLTMKMAEGAKLQMCYLLHHLYDTQLRHRVESIIAFSHDFVGDLQTDQLRRYIEIKQSDLPSAVAAKKTKEFRCPPREQMNQILCFKNLEPDDQDNCTCGLELRGRLGDFHDSLMQKVSLNALQEPDGVEGTAIEEVKTGPITKIYNFINTVKELEEGPKEVEEPEKKTPEEVFRKVLIKTIVSWAEESQIENPKLVREMFSLLLRQYDTVGELVRALEKTYVINTRARDDVAEMWVGLSQIRALLPVQMSQEEEELMRKRLWKLVNNATFFQHPDLIRILRVHENVMAVMMNTIGRRAQAQSDAPTQSEVAEGAPSKEKDTSHEMVVACCRFLCYFCRTGRQNQKAMFDHFDFLLDNANILLARPSLRGSTPLDVAYSSLMENTELALALREHYLEKIAVYLSRCGLQSNSELVEKGYPDLGWDPVEGERYLDFLRYCVWVNGESVEENANLVIRLLIRRPECLGPALRGEGEGLFRAIVEANRMSERISDRCKMQDEAEGTIAGLNFTHPLPEGEEDEDYIDTGAAILNFYCTLVDLLGRCAPDASVIEQGKNESLRARASLRSLVPLEDLQGVLSLKFTLSQTAPGEEKPKSDMPSGLLPNNKQSIVLFLERVYGIEAQDLFYRLLEDAFLPDLRTATILDKSDGSESDMALAMNRYIGNSILPLLIKHSKFYNEAENYASLLDATLHTVYRLSKNRMLTKGQREAVSDFLVALTSQMQPAMLLKLLRKLTVDVSKLSEYTTVALRLLTLHFDRCAKYYGSTQGQGSYGASSDEEKRLTMLLFSNIFDSLSNMDYDPELFGKALPCLIAIGCALPPDYSLSKNTDEDYYGRQMGAPDQPQYMPNPIDTNNVHLDNDLNSLVQKFSEHYHDAWASRRLEGGWTYGDIRSDNDRKHPRLKPYNMLSEYERERYRDPVRECLKGLLAIGWTVEHSEVEVPLNHRGSTRRQSKPQINEFQNEGSPFNYNPHPVDMSNLTLSREMQNMAERLAENSHDIWAKKKNEELNGCGGVIHPQLVPYDLLTDKEKKKDRERSQEFLKYMQYQGYKLHKPSKGGAVEEGGATQAAVELRFSYSLLEKLIQYLDRATINMKLLKPSTTFSRRSSFKTATRDIKFFSKVVLPLMEKYFSTHRNYFIAIATATNNIGAASLKEKEMVASIFCKLAALLRNRLSAFGPDVRITVRCLQVLVKGIDARTLTKNCPEFIRTSMLTFFNQTSDDLGNTILNQQDGKYSHLRGTHLKTSTSLGYVNQVVLPVLTAMFDHLAACDYGSDLLLDEIQVASYKILAALYHLGTDGTLTHDRKYLKTEIERHRPALGSCLGAYSSCFPVAFLEPHLNKHNQYSLLNRIADHSLEAQDIMVKMESCMPNLETILGEVDQFVESDKTYNDAPHIIDVILPLLCAYLPFWWSQGPDNVSPTSGNHVTMVTADHMNPLLRNVLKMIKKNIGNDNAPWMTRIAAYTQQIIINTSEELLKDPFLPLAERVKKRTENMLHKEDSMRGFIKSATDDTSQVETQLQEDWNLLVRDIYSFYPLLIKYVDLQRNHWLKDNIPEAEELYNHVAEIFNIWSKSQYFLKEEQNFISANEIDNMALIMPTATRRSAISEGAPAVGGKVKKKKKNRDKKRDKDKEVQASLMVACLKRLLPVGLNLFAGREQELVQHCKDRYLKKMPEYDVIEFARNQLTLPDKLDPSDEMSWQHYLYSKLGKTEEPVDEQALEKANVNSNEKGKDKTQETVDRIVAMAKVLFGLHMIDHPQQQSKNVYRSVVSIQRKRAVIACFRQTSLHSLPRHRACNIFARSYYEQWLQEENVGQEVMVEDLTQTFEDSEKSKKEGEETDSKPDPLTQLVTTFCRGAMTERSGALQEDLLYMSYAQIAAKSTGKEEEEGGDEEGGEGGEEGEGTSIHEQEMEKQKLLFHQARLSNRGVAEMVLLHISASKGIPSEMVMTTLNLGIAILRGGNIDIQMGMLNHLKEKKDVGFFTSIAGLMNSCSVLDLDAFERNTKAEGLGVGSEGAAGEKNMHDAEFTCALFRFIQLTCEGHNLEWQNYLRTQAGNTTTVNVVICTVDYLLRLQESIMDFYWHYSSKEIIDPAGKANFFKAIEVASQVFNTLIEVIQGPCTLNQQALAHSRLWDAVGGFLFLFSHMQDKLSKHSSQVDLLKELLNLQKDMITMMLSMLEGNVVNGTIGKQMVDTLVESASNVELILKYFDMFLKLADLIESPSFHEVDMKNEGWVTPKDFREKMEQSKNYTPEEMDFLLACCERNHEGKIDYRAFVEHFHEPSKEIGFNLAVLLTNLSEHMPNEPRLARFLETAGSVLNYFEPFLGRIEILGSSKRIERVYFEIKDSNIEQWEKPQIRESKRAFFYSIVTEGGDKEKLEAFVNFCEDAIFEMTHASGLMATDDGGGNVKRDTAYSSYMSEEEEERAARDPIRRTITAVKEGLKFGVHMLSPANIKHQIGVMQTKSIPELIVGFFKIIFYIFYYTGYAHFCVVRYIFGILLNLMRGPAPEQEEEPVVEEETFGRALPPLPLEEPPGTVQAFGLDINKEENGMYKVVVHESPANSSMEEGGESSPEDGAAASGELVEGEPHQEPISIVDLLGGEAAKKAAQERQEAQKAQEAAMASIEAEAKKSSSAPQETPAVHQIDFSQYTHRAVSFLARNFYNLKYVALVLAFSINFMLLFYKVTSFTEEADSSAEEELILGSGSGGGADITGSGFGGSGDGGSGDGEMEDEIPELVHVDEDFFYMEHVLRIAACLHSLVSLAMLIAYYHLKVPLAIFKREKEIARRLEFEGLFIAEQPEDDDFKSHWDKLVISAKSFPVNYWDKFVKKKVRQKYSETYDFDSISNLLGMEKSTFAAQESEETGIFKYIMNIDWRYQVWKAGVTFTDNAFLYSLWYFSFSVMGNFNNFFFAAHLLDVAVGFKTLRTILQSVTHNGKQLVLTVMLLTIIVYIYTVIAFNFFRKFYIQEEDEEVDKKCHDMLTCFVFHLYKGVRAGGGIGDEIGDPDGDDYEVYRIIFDITFFFFVIIILLAIIQGLIIDAFGELRDQLESVKDNMESNCFICGMGKDFFDIVPHGFDTHVQKEHNLANYMFFLMHLINKPDTEYTGQETYVWNMYQQRSWDFFPVGDCFRKQYEDELSGGGGGG

SEQ ID NO: 127 - DNA, 15387 bp, Heliothis virescens
  CDS (1)..(15384)
  pXL-Hv7
atggcggaagcagaggggggagcaagcgagcaagatgatgtttcattcttgcgtacggaagacatggtgtgcctgtcgtgcacagcgacaggagagagggtgtgcctggctgccgaaggtttcggcaaccggcactgcttcttggagaatattgccgacaagaacataccgcctgatctgtcgcagtgtgtgtttgtcatcgaacaggcgctttcagtaagagctttacaagagttggtaacagctgcgggctctgaaactggtaaaggtaccggttctggtcatcgtacgctactatacggcaatgctattcttttgcgacatcttaacagtgatatgtacctggcctgcctgtcgacatcatcctcccaggataagctggcctttgacgtgggtctgcaacagcactcccagggtgaagcctgctggtggaccctgcatcctgccagcaaacagagatccgagggtgagaaggtgcgagtcggagatgacttgattctggtctccgtggctactgagagatacttgcacacaacgaaagagaacgaagtatcgatagtgaacgcgtcgttccacgtgacgcactggtcggtacagccctatggtactggtatatcgaggatgaagtatgtaggctatgtattcggaggtgatgtgctgcggttcttccatggaggtgacgagtgtctcactatacctagcacctggacaaaggatggggggcaaaatatcgtagtgtacgaaggaggttcggtgatgtctcaagcccgttctctatggcgcctggaactggctagaaccaagtgggccggaggtttcattaactggtaccatcctatgaggattcggcacatcactactggaagatatctcggagtaaacgaccagaatgagctgtatttagttagcagagaggaagccacaacagcttcctgtgccttctgcctgcgtcaggagaaggatgatcagaagcaagtgttagaagacaaggacttggaggtcataggcgcgcccatcatcaaatatggtgactccaccgtcattgtgcagcattccgagactggcttgtggctgtcttataagtcttacgaaacgaagaagaagggagtgggtaaagtagaagagaagcaagcgattctccacgaggaaggcaagatggacgatggcctcgacttctccaggtcacaggaggaagaatctaggactgctcgagttatcaggaagtgttcttcgctgttcactaagtttatcaatggtctggaaactctacaagagaaccgtcgtcactcgatgttcttcgcgtcagtgaacctgggcgagatggtgatgtgcctcgaggatctcatcaactacttcgcacagcccgatgaggatatggaacacgaagaaaaacaaaacaaattccgggcactccgaaaccgtcaggacctgttccaagaggaaggcatactgaacctgatcctcgaagctatagacaagatcaacgtcatcacgtcccaggggttcctcgctggattcctggcgggagacgaatctggacagagctgggaaatgatatctggatatttgtatcagttgctggcggcaataataaagggcaaccacacgaactgcgcgcagttcgcgaactcgaaccgcctcaactggctgttctcgcgcctcggctcgcaggcctcgggcgagggcaccggcatgctcgacgtgctgcactgcgtgcttatagactcgcctgaagctctcaatatgatgagggacgaacacataaaagtgataatctctctattagaaaagcatgggcgcgaccctaaagtactagatgtgctatgttcgctgtgcgtcggtaacggcgtcgcggtgcgctcgtcacagaacaacatctgtgactacttactgcccggcaagaacctgttgctgcaaactgcgctcgtggatcacgtatctagtgtccgtccgaacatcttcgtgggtcgagtagaagggtcggcagtgtaccgcaaatggtacttcgaggtgactatggaccacatagagaagaccacacatatgatgccacatctacgcataggatgggccaacactactggttatgtcccatacccgggcggtggcgagaaatggggaggtaacggcgtgggagatgacctgtactcgtacgggttcgacggcgcctacctctggtccggggggaggaagactcccgtcaataggactcatgctgaagagccttatattagaaaaggtgacgtgataggttgcgcattggacctgacggtacccataatcaacttcatgttcaacggagtgcgggtgacgggatccttcaccaacttcaatctggaaggcatgttcttcccggtcatcagctgctctagtaagctgagttgtcggttcctgctgggcggagaacacggtcgtctccggtacgcggctccagaaggctactctcccttggtggagtctctcctgccgcagcagatcctcagcctggagccgtgcttctacttcggcaacctgtccaagcgggccttggctggacctccgctagtacaggacgatacggccttcgtgcctacacctgttgatactttacagattactctgcctacatatgtggaacaaattagagataagctagctgaaaatatacacgaaatgtgggctatgaataagatcgaagcaggctggatgtacggcgaccagagagaagacttgcacaagatccacccctgcctcgtgcccttcgagcgactcccacctgctgagaaacgatacgacatacaactcgctgtgcagacactcaagactatcctggctctgggctactacatcagcttagataagcctccagcacgcatccgcaacgttcgtctgcccaacgaacctttcatgcagtccaacggctacaagccagcaccactcgacctgagtgctgtcaccctgacacccaagatggatgagctagtagaccagctggctgagaacacccacaacctttgggccagggagaggatacagcagggatggacttatggacttaatgaggactcggacatgcatcgttccccgcacctggtgccatacccgaaggttgacgatgccatcaagaaggccaacagggacacagcctcggagactgtgaggaccctgctggtctacgggtatatgctggacccgcctactggggagcagcatgaagcactcttgttggaagcgtcaaaacagaagcaagcagacttcagaacataccgcgctgagaagaactatgccgtcagctctgggaagtggtacttcgagtttgagatcttaacggctggacctatgagggtcggctgggctcacgctgatatggcaccaggaatgatgctcggacaagacgagaactcttgggcatttgatggttacaatgaggaaaaagtgtacagcggtaacactgagtctttcggcaagcaatgggctgttggtgacgtagtgggggtgttcctagatctcattgataagacgataagtttctcactcaatggtgagttgttgatggatgctcttggcggagagactacgtttgctgatgtccagggtgacaactttgtaccagcttgcacacttggtgtgggccaaaaagccaggttaacatatggccaagatgtgaatactctgaaatacttcacaacatgtggtcttcaggagggatatgaaccattttgcgtcaatatgaagagagacgtgactcactggtacaccaaggaccagccgatcttcgagaatactgatgagatgatcgacaccaggattgatgtgaccaggataccagctggttcagatacacctccatgcctcaagatttcccacaacacgttcgagacgatggagaaagctaactgggagttcttacgtctctcactgcctgttatctgccataacgagttcattgacgaggcagaaaaagccagacgttgggtagaaatcaaggaccgtcaacagatcctaatgaaagaggcagttgaagctcagatgcccgcccatattgaccagatcatgaggagcggtttcaccatgaacgatatcaaaggtttgcactacgaagacaatcaggaagagttgcccagctccaagatgaagcgcctgccttcaaggccaccacgtaagggatccatgacaagaggtgttactatacaaaattacaataatttgcaaccaggccaagtcaacggcatgcaccggtcgaccagtgaagctgaaatggccaagtatgacttgggagcgcaaggtttgacgcctgatgataagaaggacaagaggggacgatcgcctttcaagttcttcagaagcaagcgcggcgaaagcagtgatcgtgctaaatcccgtaaatccaaaacaccagaccccttcagtgataccgaagtatcaccagaacgtggtgctcgaaggcctaaccctcagatcaaagtgtcacaggccaatcaaagatataacggcatgaacgcgcgtcctagcaggaccaacttgtatgggagccaagttggtttgaacatggcgacgcccacgcaagacaggaagcagatgacgaccagcactctcgcgcagtcggctacggaaactgtcggcaatgagatcttcgatgcagagtgtttgaagctcatcaatgagtacttttatggagtcaggatctacccaggtcaagacccaacccacgtgtacatcggctgggtgaccacccagtaccacttgcactctaaggacttcaaccagagcaaggtcaccaagtcctctgtcatcatcactgatgattacgatagggttgttgagaacgtaaaccggcaatcgtgctacatggtgcgagctgatgagctgtacaacgaggtgatggcggaagccacggccaagggtgcctcgcaaggcatgttcatcggctgctccgtcgacacctccaccggcagcgtgtccttcacctgtgaggggaaggacaccagcttcaagtttaagatggaaccagaaacaaaattgttccccgcgatcttcgtagaagcgacctccaaggagatcctgcagatagagctgggcagatcagccaccagtctgccactatcagccgctgtactacctacgagtgataagcatgtcataccacagttcccgccgaggttgaaggtgcagtgcttgaaaccacatcagtgggctagggtaccgaaccaatcactacaagtccacgctctgaagttgtccgacatccgcggttggtcgatgctgtgtgaagacgccgtttctatgctagctttacatataccggaggaagatcgctgcatagacattttggagccgatagaaatggacaaacttctaagtttccattctcacaccctcacgttatacgctgctttatgttaccagagtaactacagggcggcccacgctctgtgcacgcacgtggaccagaagcagctgctgtacgcgatccagtcgcagtacatgtcgggcccgctgcgccagggcttctacgatctgctcatagcactgcatctcgagtcgcatgccaccaccatggaggcgtgtaagaacgagttcgtgatcccgctgggcccggagctgaaggcgctgtacgaggagcccgacatgggacactcgctgcgctcgctgcagaccgagagcgtgcgcccgcagatgaagatgaccgatatcgctgaaagtataaccgagataagcaacctatactcgccgtacttcccgctggaggtggcgcgcgagttcgtgatgcaggcgctggctgaagccgtggagaccaaccaggtgcacaaccgggatcctgtcggggggagcaatgagaacctgttcctgcctctaataaagttggtggaccgtctcctgctggtcggcatgatgcgcgacgaagatgtggagaagctactcatcatgaccaaccctgagacatgggacccctcgtttgacaaagagggtaaagacgagcaccgcaaaggtctactccacatgaaaatggcggaaggcgctaagctgcagatgtgttacttactgcaacatctcaacgacatacagctgcggcacagggtcgaagctatcattgcgtttgcgcatgacttcgtcggtgatctacagactgatcagctcagacgttacacggaaatcaagcagtcggacttgccgagcgcggttgccgctaaaaagacgagggagttccgttgtccgcctagagaacagatgaacgctatactgagtttcaagcacttagaggaggaagacaaggagaactgtccgtgcggcgaggagctgatcgcgcgcatgaacgagttccacgacaccctcatggcgcacgtctcgctgcacgcgctgcaggagcctgatgctgcggaaaatcaagaaccagaagcaaaaccgggcgcattcggcaagttatacaacattatcaatacggtaaaggaattggaagaagaagctaaggcaattgaagagcctccgaagaagacgcctgaggagaagttccgtaaggtcctcatccagaccatcgtgaactgggctgaggagtcgcagatagaaacacccaaactcgtcagagaaatgttcagtcttctagtccgccagtacgacgcagtaggcgaactaatccgcgctctagagaagacatacgtcatcaacgcgaagaccaagttagatgtcgcggagatgtgggtggggctcagccagatccgagccctcctgccagtgcagatgagccaggaggaagaggaactcatgaggaagaggctctggaaacttgtgaacaaccacacattcttccagcatccagacttgatcagggtgctccgcgtgcacgagaacgtgatggcggtgatgatgaacacgctcggccgccgcgcgcaggcgcagtccgacgcacagccctcctcgcagcctgtcgcagaggacagcaaggagaaggacacatcacacgagatggtggtagcttgctgccgttttctctgctacttctgccgcaccgggagacagaaccagaaggctatgttcgaccacttcgacttcctcctggagaactccaacatcctgctgtccagaccctcgctgagaggatccacgcctctagacgtggcttactccagtcttatggagaacactgaactggcgctggctttgagagagcactacctggagaagatagcagtatacctgtcccgttgtggtctgcagagcaactcggagctggtggagaaggggtaccctgacctcggctgggatccggtcgagggggagcggtatcttgacttcctgaggttctgtgtttgggtaaacggcgaaagcgtagaagaaaacgcgaacctagtgatccgtctcctgatccgtcgtccggagtgcctcgggccggcgctgcgcggcgagggcgagggcctgctgaaggccatcgtcgacgccaacaagatgagcgagaggatcgccgacaggaggaagctcagggaaatggagcaggagggagatgttaacttcagccaccccctcccggagtcagatgaggatgaggactacatagacacgggcgccgccatcttgaacttctactgtaccttggtagatttgctcggaagatgtgctcctgatgccggtgttattgctctcggcaagaacgagtctctccgtgcccgcgctatcctgcggtcgctggtgccgctggaggacctgcagggagtgctgagcctgcgcttcacgctcaacaaccctgctgctggagaggaacgacccaagtctgatatgccatcgggtctgatcccgggacacaagcagagcgtgggactgttcctagagagagtgtacggcatcgaaactcaggagttgttctacaaactgctggaggaagccttcctgccagacctcagggctgccactatgctggacaggaacgacggctgcgagtcagacatggcgctgtcgatgaaccgctacatcggcaactcgatcctgccgctgctgatcaagcacgcgtacttctacaacgaagctgagaactacgccagtttattggatgccacgctacatactgtttataggttatcgaagaatcgcatgttaaccaagggccagcgtgaagcggtgtcagacttcctcgtggcgcttacttcagcgatgcagccttccatgttgctcaagctgctcaggaaattgacggtcgacgtgtctaaactgtccgagtataccactgtcgctcttaggctgctgacgctgcactacgagcgctgcgcgaagtactacggcagcacgggcgcggggcagggcgcgttcggcgcgtcgtcggacgaggagaagcgcctcaccatgatgctcttctccaacatcttcgactcgctcagcaagatggactacgagcccgagctcttcgggaaggcgctgccctgtcttattgctataggatgcgctctgcctcctgactactctctctcaaagaactatgatgacgagttttacggcaaggagcaagctgcaggtgacttagacaatccccaatacgaccctcagcccataaacacgtcctcagtagcattaaacaatgatctcaacacgatcgtacagaagttctcggaacattaccacgatgcgtgggctagtaggaagattgagaacggctgggtgtatggagagggctggtctgatagccagaagacgcatcctaggctgaagccttataatatgcttaatgattatgaaaaagagcgttacaaggagccagtacgtgaatctctgaaggcacttctagccatcggttggtctgtggaacattcagaagtagacataccgagtaacaaccgaagctccatgaggaggcagtccaagtcgggaggccgccctcccgaaattgtgacagactcggcgactccattcgactacaaccctcacccagtcgacatgaccaacttgacgctatcgagggagatgcagaacatggcggagaggctcgctgacaacgcacatgacatctgggcgaagaagaagaaggaagaacttgttactaatggaggtggcatccacccccaactagtaccctacgacctcctaacagacaaagaaaagaagaaagatcgagaacgttctcaggagttcctcaaatacctgcagtaccaagggtacaagctccaccggcccagcaaggcgccacaaagtgatacggaacaaaccactacgggggtagcaatagagttgagatttgcgtactcgctccttgagaaattgatccagtacatcgatagggccaccattaatatgaagcttttgaaaccttcgactacattcagtaggagaagtagttttaagactagtaccagggatattaagttcttttctaaggcggtgctgcctctaatggagaagtatttctcaacgcatcgtaactacttcatagcagtagctactgcgaccaataatgttggtgcagccagcctgaaggagaaagagatggtagccgcgctgttctgtaagcttgctagcttgcttagatctagactcgcagctttcggtcctgacgtccgcatcacagtccgctgtctccaagtgttggtgaagggcatcgacgccaagtccttagtgaagaactgccccgagttcatcaggacctccatgttgaccttcttcaacaatgtcgctgatgatgtagggcataccatcatgaatttacaggatggtaaatacgcgcaccttcgaggtacacatttgaagacgtccacgtccctgggctatatcaatggagtactgctccccatactgacggccaagttcgaccatctggctaactgcgagtacggtgctgatctgttgttggacgagatacaagtggcgtcatacaagatgttgggctccctgtacgcgctcggcacggacgcttcgctcacacacgacagaaagtacctcaagactgagattgagagacataaacctgctttgggttcgtgtctaggtgcgttcagttcgacattcccagtggcgttcttggaacctcacctgaacaaacacaaccagttctccttgctgaacaggatcgctgaccattctttggaagcccaagacataatgcagaaaatggaacaatgcatgccgacgctagagacgatcttaggcgaggtggaccaattcgtggagtcagacaagacgtacaacgaggcgccgcatatcatcgatgtggtgctgcctttactctgttcttatttgccgttctggtgggcacaggggcctgataatgttactcctactggcggaaaccacgtaacaatggtaacagcggaacacatgaaccagctcctcaagaatgttctgaagctcatcaaaaagaacatcggcaatgagaacgcgccgtggatgacccgcatcgccacctacacgcagcagatcatcatcaacagctccgaggaactgctgagggattccttcctgccgctcgctgaacgtgttcgcaaacgcacggacaatatgttccataaggaggagagcttgagggggtttattaagtcgtcaacagacgacacatcccaggtagagtctcagatacaagaagactggcagctgctggtcagagacatctactccttctacccgctgctcatcaagtacgtcgacctgcagaggaaccactggctcaggaacaatgttccagaggcggaagagctgtacaaccacgtggctgaaatcttcaacatctggtcgaagagccagtacttcttgaaggaggaacagaacttcatctctgccaacgaaattgataacatggtgctgattatgccaacagcaacaagaagagtgacagcagtaacagatggtactcctcaaggtggtggaaagaaaaagaagaagcaccgtgataagaaacgcgacaaagacaaggaagtccaagcgtccctaatggtagcttgtctgaagaggttgttaccagttggccttaacctattcgctggcagagaacaagaactggtgcagcattgtaaagacaggttcctgaagaaaatgtcagaacaagatgtggcagaattcgcgaagacccagctgacacttccagataaaatagatccggcagacgaaatgtcttggcaacattacttgtatagcaagttaggttcgaagagtaagagcaatataactgtggaaactgctgaaaataaggccaagattattgatgataccgtcgagagaatcgtcgctatgagtaaagtgcttttcggattgcatatgatcgaccatccccaacaaatgagtaagaacgtgtaccggtcggtggtgtcgatacaacgcaagcgcgccgtcatcgcctgcttccgacaaacttcactacattctctgccgagacatcgagcgtgtaacatcttcgctcgcacgtactacgagctctggttggaagaggagaacattggacaagaagtaatgatagaagatcttactcaatcattcgaagacgcagagctgaagaagagtgacgtggtggaggaaggtgagaagcctgaccccctcacgcagctggtcaccaccttctgtcgcggtgccatgactgagaggtccggcgctttgcaggaggatcctctatacatgtcttacgcacacatcatagcgaagtcctgtggagaagaagaggaagaagggggtggggaggaagaggaagggggtggagaagcagaggctgaagacgaaggcagagccagtatacacgaacaagaaatggagaaacaaaagctcctattccaccaagcgcggctggcggaccgtggggttgccgaaatggtgttgctgcacatctccgcgtccaaaggcctgcccagcgagatggtcatgaagactttacagctcggtattagtatactgaggggcggcaatattgatatacagatgggtatgttgaaccacttgaaagacaagaaagacgtgggcttctttacgtccatcgccggcctcatgaactcctgctccgtgctcgatcttgacgccttcgagaggaacaccaaggctgaaggtctgggcgtgggtctggaaggtgcggcgggagagaagaacatgcatgacgccgagttcacctgcgcactcttcaggttcattcagctcacctgtgaaggacacaacttggactggcagaactacctgcgaactcaggccggtaacacgacaacagtgaacgtggtcatctgcaccgtcgactacctgctgcggctgcaggagtccatcatggacttctactggcactactcaagcaaggaactgatcgacccggccggcaaagcgaacttcttcaaggccattggcgtggcttcccaagtattcaacaccctcactgaagtcatacagggaccttgtacgcagaatcagcaggctttggctcactccaggttgtgggacgctgtcggtggtttcctgttcctattctcccacatgcaggacaagttgtcgaagcactcgtcgcaggtggacctgctgaaggaactcctcaatctgcagaaggacatgatccccatgatgctgtccatgcttgaaggaaatgttgttaatggtacaatcggcaagcaaatggtggacacactagtagaatcggcctccaacgtggaactgatcctgaaatacttcgacatgttcctcaagctgaaggacctgacctccagcgccagcttccaggagattgatgccaataacgacggctgggtgctgcccaaggacttcaaggagaaaatggaacaacagaagagttatactcccgaagaaatcgagttcctcctagcttgctgcgagacgaaccacgacggcaagttagactacatcggtttctgcgaccgtttccacgagcctgccaaggagatcgggtttaacttggccgtgttactgactaacttgtctgaacatatgccgaacgagcctagattggcacgtttcctggagacggcaggttcagtcctgaactacttcgaaccattcctgggccgtatcgagatcatgggcggctccaagcgcatcgagcgtgtctacttcgagatcaaggagtctaatatagaacagtgggagaaaccgcaaattaaggaatccaaacgcgcgttcttctacagcatagtaacagaaggtggtgataaagaaaaattggaggctttcgtgaacttctgtgaggacgccatctttgaaatgacgcacgcgtcgggactgatggccgcgtccgaagagtcggtgggagggaccaagaatagagaggccagctatatgtatatgggggatgatgatgatgagagagccggcaaagatccattccgtcgcggactccagtcagtcaaagacggcgtcgccacggcattttcatccttatctccttccaacataaaggcgaaaatcgcagacatgcagcaaatgccaccagccgaactagctgtgggcttcttcaaaatgttcttctatctattctattacttgggctatggagttctcgtcgttgtcaggtatatattcggtgtgctcttgggtctgatgcgaggtcctcagacggatgaaccgcctccggagccgacggaagaggagaaaatcggtcagttgagacacaggttgctagcgacacaaagttctcgacatctcccggcgttgcctccagctgatgatacgggacagatgcaagtgtcggcattcggactcgatatcaccaaagaagacaatggacagatacaagtaaaacctcacgaatcacccagcacatccactccatcatcaggcgaggaggcggaggtgtcacccgacgagagcgccgaccacacggaggagcagagaccgccttctcttatcgacctgcttggtggggaacaagctaaaaagcaagctcaggagaggatggaagctcaagctgctcaacaagctgccatgtcggccattgaagctgaaagcaaaaaggcagtgcaagggcccgcaccatcagcgctatctcaagtggacctgtcccagtacacccggcgcgcagtctcgttcctagctcgcaacttctacaacctgaagtacgtggcgctcgtgctggccttctgtatcaacttcgtgctgctcttctataaggtatctaccctggatggtgaaggtggtgaaggttcaggtctgggtgacatcatcgccggtgggggttccggatccggggctggctctggcagtggagacggtagcggcgagtcaggggaagatgacgacgcgttagaagtagtacacatagacgaagacttcttctatatggaacacgtcatcaagatggcggccgtgctgcactctatcgtgtctctggctatactcatcggatattatcatcttaaggtgccgctagccatcttcaaacgtgagaaggagatcgctcgtaagctggaattcgacgggctgtacatcgctgaacagcctgaagacgacgacctcaagagccactgggacaagctcgttatatctgccaaatcattccccgtaaactactgggacaagtttgtgaagaagaaggttcgcgccaaatactcggagacatatgacttcgactccatctccaacatgttgggcatggagaagacttccttctccgcgcaagaagaagaaggcagcaaaggacttattcattacataatcaacatagactggcgctaccaagtgtggaaggccggcgtgacgatcacagacaactcgttcctctactcgctatggtacttctccttctccgtgatggggaacttcaacaacttcttcttcgcggcacatttgttggacgtggctgttgggtttaagaccctgaggactatcttgcagtctgtcacgcataatggaaaacagctggtattaacggtgatgctgctgactataatcgtgtacatctacacggtgatcgcgttcaacttcttccgcaagttctacgtgcaggaggaggacgacgaagtcaataggaactgccatgacatgttgacgtgcttcgtgttcaacttgtacaagggtgtgcgggcgggcggcggcatcggcgacgagctggagccgcctgatggagacgactccgaggtctaccgcatcatcttcgacatctccttcttcttcttcatcatcgttatcctgctcgctatcctgcagggtttgatcatcgacgcgttcggagagctgcgtgaccagttggagtcggtcaaggaggacatggagtccaactgcttcatctgcggcatcaataaagactattttgataaagtgccgcacgggttcgacacacacgtgcaaagggaacacaatttagctaattacatgttcttcctcatgcatctcattaataaacccgatacggagtatacaggtcaagaaacctacgtatggaacatgtacacacaaagatgttgggactttttccccgtgggagattgtttccgaaagcaatacgaagacctcatgggagaatag

SEQ ID NO: 128 - protein, 5128 aa, Heliothis virescens
  pXL-Hv7
MAEAEGGASEQDDVSFLRTEDMVCLSCTATGERVCLAAEGFGNRHCFLENIADKNIPPDLSQCVFVIEQALSVRALQELVTAAGSETGKGTGSGHRTLLYGNAILLRHLNSDMYLACLSTSSSQDKLAFDVGLQQHSQGEACWWTLHPASKQRSEGEKVRVGDDLILVSVATERYLHTTKENEVSIVNASFHVTHWSVQPYGTGISRMKYVGYVFGGDVLRFFHGGDECLTIPSTWTKDGGQNIVVYEGGSVMSQARSLWRLELARTKWAGGFINWYHPMRIRHITTGRYLGVNDQNELYLVSREEATTASCAFCLRQEKDDQKQVLEDKDLEVIGAPIIKYGDSTVIVQHSETGLWLSYKSYETKKKGVGKVEEKQAILHEEGKMDDGLDFSRSQEEESRTARVIRKCSSLFTKFINGLETLQENRRHSMFFASVNLGEMVMCLEDLINYFAQPDEDMEHEEKQNKFRALRNRQDLFQEEGILNLILEAIDKINVITSQGFLAGFLAGDESGQSWEMISGYLYQLLAAIIKGNHTNCAQFANSNRLNWLFSRLGSQASGEGTGMLDVLHCVLIDSPEALNMMRDEHIKVIISLLEKHGRDPKVLDVLCSLCVGNGVAVRSSQNNICDYLLPGKNLLLQTALVDHVSSVRPNIFVGRVEGSAVYRKWYFEVTMDHIEKTTHMMPHLRIGWANTTGYVPYPGGGEKWGGNGVGDDLYSYGFDGAYLWSGGRKTPVNRTHAEEPYIRKGDVIGCALDLTVPIINFMFNGVRVTGSFTNFNLEGMFFPVISCSSKLSCRFLLGGEHGRLRYAAPEGYSPLVESLLPQQILSLEPCFYFGNLSKRALAGPPLVQDDTAFVPTPVDTLQITLPTYVEQIRDKLAENIHEMWAMNKIEAGWMYGDQREDLHKIHPCLVPFERLPPAEKRYDIQLAVQTLKTILALGYYISLDKPPARIRNVRLPNEPFMQSNGYKPAPLDLSAVTLTPKMDELVDQLAENTHNLWARERIQQGWTYGLNEDSDMHRSPHLVPYPKVDDAIKKANRDTASETVRTLLVYGYMLDPPTGEQHEALLLEASKQKQADFRTYRAEKNYAVSSGKWYFEFEILTAGPMRVGWAHADMAPGMMLGQDENSWAFDGYNEEKVYSGNTESFGKQWAVGDVVGVFLDLIDKTISFSLNGELLMDALGGETTFADVQGDNFVPACTLGVGQKARLTYGQDVNTLKYFTTCGLQEGYEPFCVNMKRDVTHWYTKDQPIFENTDEMIDTRIDVTRIPAGSDTPPCLKISHNTFETMEKANWEFLRLSLPVICHNEFIDEAEKARRWVEIKDRQQILMKEAVEAQMPAHIDQIMRSGFTMNDIKGLHYEDNQEELPSSKMKRLPSRPPRKGSMTRGVTIQNYNNLQPGQVNGMHRSTSEAEMAKYDLGAQGLTPDDKKDKRGRSPFKFFRSKRGESSDRAKSRKSKTPDPFSDTEVSPERGARRPNPQIKVSQANQRYNGMNARPSRTNLYGSQVGLNMATPTQDRKQMTTSTLAQSATETVGNEIFDAECLKLINEYFYGVRIYPGQDPTHVYIGWVTTQYHLHSKDFNQSKVTKSSVIITDDYDRVVENVNRQSCYMVRADELYNEVMAEATAKGASQGMFIGCSVDTSTGSVSFTCEGKDTSFKFKMEPETKLFPAIFVEATSKEILQIELGRSATSLPLSAAVLPTSDKHVIPQFPPRLKVQCLKPHQWARVPNQSLQVHALKLSDIRGWSMLCEDAVSMLALHIPEEDRCIDILEPIEMDKLLSFHSHTLTLYAALCYQSNYRAAHALCTHVDQKQLLYAIQSQYMSGPLRQGFYDLLIALHLESHATTMEACKNEFVIPLGPELKALYEEPDMGHSLRSLQTESVRPQMKMTDIAESITEISNLYSPYFPLEVAREFVMQALAEAVETNQVHNRDPVGGSNENLFLPLIKLVDRLLLVGMMRDEDVEKLLIMTNPETWDPSFDKEGKDEHRKGLLHMKMAEGAKLQMCYLLQHLNDIQLRHRVEAIIAFAHDFVGDLQTDQLRRYTEIKQSDLPSAVAAKKTREFRCPPREQMNAILSFKHLEEEDKENCPCGEELIARMNEFHDTLMAHVSLHALQEPDAAENQEPEAKPGAFGKLYNIINTVKELEEEAKAIEEPPKKTPEEKFRKVLIQTIVNWAEESQIETPKLVREMFSLLVRQYDAVGELIRALEKTYVINAKTKLDVAEMWVGLSQIRALLPVQMSQEEEELMRKRLWKLVNNHTFFQHPDLIRVLRVHENVMAVMMNTLGRRAQAQSDAQPSSQPVAEDSKEKDTSHEMVVACCRFLCYFCRTGRQNQKAMFDHFDFLLENSNILLSRPSLRGSTPLDVAYSSLMENTELALALREHYLEKIAVYLSRCGLQSNSELVEKGYPDLGWDPVEGERYLDFLRFCVWVNGESVEENANLVIRLLIRRPECLGPALRGEGEGLLKAIVDANKMSERIADRRKLREMEQEGDVNFSHPLPESDEDEDYIDTGAAILNFYCTLVDLLGRCAPDAGVIALGKNESLRARAILRSLVPLEDLQGVLSLRFTLNNPAAGEERPKSDMPSGLIPGHKQSVGLFLERVYGIETQELFYKLLEEAFLPDLRAATMLDRNDGCESDMALSMNRYIGNSILPLLIKHAYFYNEAENYASLLDATLHTVYRLSKNRMLTKGQREAVSDFLVALTSAMQPSMLLKLLRKLTVDVSKLSEYTTVALRLLTLHYERCAKYYGSTGAGQGAFGASSDEEKRLTMMLFSNIFDSLSKMDYEPELFGKALPCLIAIGCALPPDYSLSKNYDDEFYGKEQAAGDLDNPQYDPQPINTSSVALNNDLNTIVQKFSEHYHDAWASRKIENGWVYGEGWSDSQKTHPRLKPYNMLNDYEKERYKEPVRESLKALLAIGWSVEHSEVDIPSNNRSSMRRQSKSGGRPPEIVTDSATPFDYNPHPVDMTNLTLSREMQNMAERLADNAHDIWAKKKKEELVTNGGGIHPQLVPYDLLTDKEKKKDRERSQEFLKYLQYQGYKLHRPSKAPQSDTEQTTTGVAIELRFAYSLLEKLIQYIDRATINMKLLKPSTTFSRRSSFKTSTRDIKFFSKAVLPLMEKYFSTHRNYFIAVATATNNVGAASLKEKEMVAALFCKLASLLRSRLAAFGPDVRITVRCLQVLVKGIDAKSLVKNCPEFIRTSMLTFFNNVADDVGHTIMNLQDGKYAHLRGTHLKTSTSLGYINGVLLPILTAKFDHLANCEYGADLLLDEIQVASYKMLGSLYALGTDASLTHDRKYLKTEIERHKPALGSCLGAFSSTFPVAFLEPHLNKHNQFSLLNRIADHSLEAQDIMQKMEQCMPTLETILGEVDQFVESDKTYNEAPHIIDVVLPLLCSYLPFWWAQGPDNVTPTGGNHVTMVTAEHMNQLLKNVLKLIKKNIGNENAPWMTRIATYTQQIIINSSEELLRDSFLPLAERVRKRTDNMFHKEESLRGFIKSSTDDTSQVESQIQEDWQLLVRDIYSFYPLLIKYVDLQRNHWLRNNVPEAEELYNHVAEIFNIWSKSQYFLKEEQNFISANEIDNMVLIMPTATRRVTAVTDGTPQGGGKKKKKHRDKKRDKDKEVQASLMVACLKRLLPVGLNLFAGREQELVQHCKDRFLKKMSEQDVAEFAKTQLTLPDKIDPADEMSWQHYLYSKLGSKSKSNITVETAENKAKIIDDTVERIVAMSKVLFGLHMIDHPQQMSKNVYRSVVSIQRKRAVIACFRQTSLHSLPRHRACNIFARTYYELWLEEENIGQEVMIEDLTQSFEDAELKKSDVVEEGEKPDPLTQLVTTFCRGAMTERSGALQEDPLYMSYAHIIAKSCGEEEEEGGGEEEEGGGEAEAEDEGRASIHEQEMEKQKLLFHQARLADRGVAEMVLLHISASKGLPSEMVMKTLQLGISILRGGNIDIQMGMLNHLKDKKDVGFFTSIAGLMNSCSVLDLDAFERNTKAEGLGVGLEGAAGEKNMHDAEFTCALFRFIQLTCEGHNLDWQNYLRTQAGNTTTVNVVICTVDYLLRLQESIMDFYWHYSSKELIDPAGKANFFKAIGVASQVFNTLTEVIQGPCTQNQQALAHSRLWDAVGGFLFLFSHMQDKLSKHSSQVDLLKELLNLQKDMIPMMLSMLEGNVVNGTIGKQMVDTLVESASNVELILKYFDMFLKLKDLTSSASFQEIDANNDGWVLPKDFKEKMEQQKSYTPEEIEFLLACCETNHDGKLDYIGFCDRFHEPAKEIGFNLAVLLTNLSEHMPNEPRLARFLETAGSVLNYFEPFLGRIEIMGGSKRIERVYFEIKESNIEQWEKPQIKESKRAFFYSIVTEGGDKEKLEAFVNFCEDAIFEMTHASGLMAASEESVGGTKNREASYMYMGDDDDERAGKDPFRRGLQSVKDGVATAFSSLSPSNIKAKIADMQQMPPAELAVGFFKMFFYLFYYLGYGVLVVVRYIFGVLLGLMRGPQTDEPPPEPTEEEKIGQLRHRLLATQSSRHLPALPPADDTGQMQVSAFGLDITKEDNGQIQVKPHESPSTSTPSSGEEAEVSPDESADHTEEQRPPSLIDLLGGEQAKKQAQERMEAQAAQQAAMSAIEAESKKAVQGPAPSALSQVDLSQYTRRAVSFLARNFYNLKYVALVLAFCINFVLLFYKVSTLDGEGGEGSGLGDIIAGGGSGSGAGSGSGDGSGESGEDDDALEVVHIDEDFFYMEHVIKMAAVLHSIVSLAILIGYYHLKVPLAIFKREKEIARKLEFDGLYIAEQPEDDDLKSHWDKLVISAKSFPVNYWDKFVKKKVRAKYSETYDFDSISNMLGMEKTSFSAQEEEGSKGLIHYIINIDWRYQVWKAGVTITDNSFLYSLWYFSFSVMGNFNNFFFAAHLLDVAVGFKTLRTILQSVTHNGKQLVLTVMLLTIIVYIYTVIAFNFFRKFYVQEEDDEVNRNCHDMLTCFVFNLYKGVRAGGGIGDELEPPDGDDSEVYRIIFDISFFFFIIVILLAILQGLIIDAFGELRDQLESVKEDMESNCFICGINKDYFDKVPHGFDTHVQREHNLANYMFFLMHLINKPDTEYTGQETYVWNMYTQRCWDFFPVGDCFRKQYEDLMGE

SEQ ID NO: 129 - DNA, 15405 bp, Heliothis virescens
  CDS (1)..(15402)
  pXL-Hv2
atggcggaagcagaggggggagcaagcgagcaagatgatgtttcattcttgcgtacggaagacatggtgtgcctgtcgtgcacagcgacaggagagagggtgtgcctggctgccgaaggtttcggcaaccggcactgcttcctggagaatattgccgacaagaacataccacctgatctgtcgcagtgtgtgtttgtcatcgaacaggcgctttcagtaagagctttacaggagttggtaacggctgcgggttctgaaactggtaaaggtaccggttctggtcatcgtacgctactatacggcaatgctattcttttgcgacatcttaacagtgatatgtacctggcctgcctgtcgacatcatcatcccaggataagccggcctttgacgtgggtctgcaacagcactcccagggtgaagcctgctggtggaccctgcatcctgccagcaaacagagatccgagggtgagaaggtgcgagtcggagatgacttgattctggtctccgtggctactgagagatacttgcacacaacgaaagagaacgaagtatcgatagtgaacgcgtcgttccacgtgacccactggtcggtacagccctatggtactggtatatcgaggatgaagtatgtaggctatgtgttcggaggtgatgtgctgcggttcttccatggaggtgacgagtgtctcactatacctagtacctggacaaaggatggggggcaaaatatcgtagtctacgaaggaggttcagtgatgtctcaagcccggtctttatggcgcctggagctggctagaaccaagtgggccggaggtttcattaactggtaccatcctatgaggattcggcacatcactactggaagatatctcggagtaaacgaccagaatgagctgtatttagttagcagagaggaagccacaacagcttcctgtgccttctgcctgcgtcaggagaaggatgatcagaaacaagtgttagaagacaaggacttggaggtcataggcgcgcccatcatcaagtacggtgactccaccgtcattgtgcagcattccgagactggcttgtggctgtcttataagtcttacgaaacgaagaaggagggagtgggtaaagtagaagagaagcaagcgattctccacgaggaaggcaagatggacgacggcctcgacttctccaggtcacaggaggaagaatctaggactgctcgagttatcagaaagtgttcttcgctgttcactaagtttatcaatggtctggaaactctacaagagaaccgtcgtcactcgatgttcttcgcgtcagtgaacctgggcgagatggtgatgtgcctcgaggatctcatcaactacttcgcacaacccgatgaagatatggaacacgaagaaaagcaaaacaaattccgcgccctccgcaaccgtcaggacctgttccaagaggaaggcatactgaacctgatcctcgaagctatagacaagatcaacgtcatcacgtctcaggggttcctggctggtttcctggcgggagacgaatctggacagagctgggaaatgatatctggatatttgtatcagttgttggcggcaataataaagggcaaccacacgaactgcgcgcagttcgcgaactcgaaccggctgaactggctgttctcgcgcctcggctcgcaggcctcgggcgagggcactggcatgctcgacgtgctgcactgcgtgctcatcgactcgcctgaagcgttgaatatgatgagggacgaacacataaaagtgataatctctctattagaaaagcacgggcgcgaccctaaagtactagatgtgttatgttcactctgcgtcggtaacggcgtcgcggtgcgctcgtcacagaacaacatctgtgactatttgctgcccggcaagaacctgttgctgcaaactgcgcttgtagatcacgtatctagtgtccgtccgaacatcttcgtgggtcgagtagaagggtcggcagtgtaccgcaaatggtacttcgaagtgactatggaccacatagagaagaccacacatatgataccacatctacgcataggatgggctaacactactggctacgtcccatacccgggtggtggtgaaaagtggggaggtaacggcgtgggagacgacctgtactcgtacgggttcgacggcgcctacctctggtccggcgggaggaaaactcccgtcaataggactcatgctgaagagccttatattaggaaaggtgacgtgataggttgtgcgttagacctgacggtacccatcatcaacttcatgttcaacggagtgcgggtgacgggatccttcaccaacttcaatctggaaggcatgttcttcccggtcatcagctgctctagtaaattgagttgccggttcctgctgggcggggaacatggtagactccggtacgcggctccagaaggctactccccgctggtggagtctctcctgccgcagcagatcctcagcctggagccttgcttctacttcggcaacctgtccaagcgcgccctggctggacccccgctagtacaggacgatacggcttttgtgcctacacctgttgacactttacagattactctgcctacatatgtggaacaaatcagagacaagctagctgaaaatatacacgaaatgtgggctatgaataagatcgaagcaggctggatgtacggcgatcagagagaagacttgcacaagatccacccctgcctcgtgcccttcgagcgtctcccgcccgctgagaaacgatacgacatacaactcgctgtgcagacactcaagacaatcctggctctgggctactacatcagcttagataagcctccagcacgcatccgcaacgttcgtctgcccaacgaacctttcatgcagtccaacggctacaagccagcaccactcgacctgagtgctgtcaccctgacacccaagatggatgagctagtagaccagctggctgagaacacccacaacctttgggccagggagaggatacagcagggatggacttacggacttaatgaggactcggacatgcatcgatccccgcacctggtgccatacccgaaggttgacgatgccatcaagaaggccaacagggacacagcctcggagactgtgaggaccctgctggtctacgggtatatgctggacccgcctactggggagcagcatgaagcactcttgttggaagcgtcaaaacagaagcaagccgacttcagaacataccgcgctgagaagaactatgccgtcagctctgggaagtggtacttcgagtttgagatcctaacggctggacctatgagggtcggctgggctcacgctgatatggcaccaggaatgatgctcggacaagacgagaactcctgggcatttgatggttacaatgaggaaaaagtgtacagcggtaacactgagtctttcggcaagcaatgggctgttggtgacgtagtgggggtgttcctagatctcattgataagacgataagtttctcactcaacggtgagttattgatggatgctcttggcggagagactacgtttgctgatgtccagggtgacaactttgtacctgcttgcacgcttggtgtcggccaaaaagccaggttaacatacggtcaggacgtaaacacgctgaaatacttcacaacatgtggtctgcaggagggatatgaaccattctgtgtcaatatgaagagagacgtgactcactggtacaccaaagaccagccgatcttcgagaatacggatgagatgatcgacaccagaatagatgtgaccaggataccagctggttcagatacacctccatgcctcaagatttcccacaacacgtttgagacgatggagaaagctaactgggagttcttacgtctctcactgcctgtcatctgccataacgagttcattgacgaggcagaaaaagccaggcgttgggtagaaatcaaggaccgccaacagatcctaatgaaagaggcagttgaagctcagatgcccgcccatattgaccagatcatgaggagcggtttcaccatgaacgatattaaaggtttgcactacgaagacaatcaggaagagttgcccagctccaagatgaagcgcctgccttcaaggccaccacgtaagggatccatgacaagaggtgttactatacaaaattacaataatttgcaaccaggtcaagtcaatggcatgcaccggtcgaccagtgaagctgaaatggccaagtatgacttgggagcgcaaggtttgacgcctgatgataagaaggacaagaggggacgatcgcctttcaagttcttcagaagcaagcgcggcgaaagcagtgatcgtgccaaatcccgtaaatccaaaactccagatcccttcagcgataccgaggtatcaccagaacgtggtgctcgaaggcctaaccctcagatcaaagtgtcacaggccaatcaaagatataacggcatgaacgcgcgtcctagcaggaccaacttgtatgggagccaagttggtttaaacatggcgacgcccacgcaagacaggaagcagatgacgacgagcactctcgcgcagtcggctacggaaactgtcggcaatgagatcttcgatgcagagtgcttgaagctcatcaatgagtacttttatggagtcaggatctacccaggtcaggacccaacacacgtgtacatcggctgggtgaccacccagtaccacttgcactctaaggacttcaaccagagcaaggtcaccaagtcctctgtcatcatcactgatgattacgatagggttgttgagaacgtaaaccggcagtcctgctacatggtgcgagctgacgagctatacaacgaggtgatggcggaagccacggccaagggcgcctcgcagggcatgttcatcggctgctccgtcgacacctccaccggcagcgtgtccttcacctgcgaggggaaggacaccagcttcaagttcaagatggaaccagaaacaaaactgttccccgcgatcttcgtagaagcgacctccaaggagatcctgcagatagagctgggcagatcagccaccagccttccactatcagccgctgtactaccaacgagtgataagcatgtcataccacagttcccaccgaggttgaaggtgcagtgcttgaaaccacatcagtgggctagggtaccgaaccaatccctacaagtccacgctctgaagttgtccgacatccgcggttggtcgatgctgtgtgaagacgcagtgtctatgctggctttgcacataccggaggaagatcgttgcatagacattttggagctgatagaaatggacaaacttttaagtttccattctcacaccctcacgttatacgctgctttatgttaccagagtaactacagggctgcccacgctctgtgcacgcacgtggaccagaagcagctgctgtacgcgatccagtcgcagtacatgtcgggcccgctgcgccaaggcttctacgatcttctcatagcgctgcatctcgagtcgcatgccaccaccatggaggcgtgtaagaacgagttcgtgatcccgctgggcccggagctgaaggcgctgtacgaggagcccgacatgggacactcgctgcgctcgctgcagaccgagagcgtgcggccgcagatgaagatgaccgatatcgctgaaagtataaccgagatcagcaacctatactcgccgtacttcccgctggaggtggtgcgcgagttcgtgatgcaggcgctggctgaagccgtggagaccaaccaggtgcacaaccgggatcctgtcggggggagcaatgagaacctgttcctgcctctaataaagctggtggaccgtcttctactagtcggcatgatgcgcgacgaggatgtggagaagctactcatcatgaccaaccctgagacgtgggacccctcgtttgataaagagggtaaagacgagcaccgcaaaggtctactccacatgaaaatggcggaaggcgctaagctgcagatgtgttacttactgcaacatctcaacgacatacagctgcggcacagggtcgaagctatcattgcgtttgcgcatgacttcgtcggtgatctacagactgatcagctcagacgttacacggaaatcaagcagtcggacttgccgagcgcggtggccgctaagaagaccagggagttccggtgtccgcctagagaacagatgaacgctatattgagtttcaagcacttagaggaggaggacaaggagaactgtccgtgcggcgaggagctgatcgcgcgcatgaacgagttccacgacaccctcatggcgcacgtctcgctgcacgcgctgcaggagcccgatgccgcggaaaatcaagaacctgaagcaaaaccgggggcattcggcaagctatacaacattatcaatacggtcaaggaattagaagaggaagctaaggcaatagaagagcctccgaagaagacgcctgaggagaagttccgtaaggtcctcatccagaccatagtgaactgggctgaggagtcgcagatagaaacacccaaactcgtcagagaaatgttcagccttcttgtccgccagtacgacgcagtaggcgagctgatccgcgctttagagaagacatacgtcatcaacgctaagaccaagttggatgtcgcggggatgtgggtggggctcagccagatccgagccctcctgccggtgcagatgagccaggaggaagaggaactcatgaggaagaggctctggaaacttgtgaacaaccacacgttcttccagcatccagacttaatcagagtgctccgcgtgcacgagaacgtgatggcggtgatgatgaacacgctcggccgccgcgcgcaggcgcagtccgacgcacagccctcctcgcagcctgtcgcagaggataacaaggagaaggacacatcacacgagatggtggtagcttgctgccgtttcctctgctacttctgccgcaccgggagacagaaccagaaggcaatgttcgaccacttcgacttcctcctggagaactccaacatcttgctgtccagaccttcgctgagaggatccacgcctctagacgtggcttattccagtcttatggagaacactgaactggcgctggctttgagagagcactacctggagaagatagcagtatacctgtcccgttgtggtctgcagagcaactcggagctggtggagaaggggtaccctgacctcggctgggatccggtcgagggggagcggtatcttgacttcctgaggttctgtgtttgggtaaacggcgaaagcgtagaagaaaacgcgaatctagtgatccgtctcctgatccgtcgtccggagtgcctcgggccggcgctgcgcggcgagggcgagggcctgctgaaggctatcgtcgacgccaacaagatgagcgagaggatcgccgacaggaggaagctcagggaaatggagcaggaaggagatgttaacttcagccaccctctcccggagtcagatgaggatgaggactacatagacacgggggccgccatcttgaacttctactgtacattggtagatctgctcggaagatgtgctcctgatgctggcgttattgctctcggcaagaacgagtctctccgtgcccgcgctatcctgcggtcgctggtgccgctggaggacctgcagggagtgctgagcctgcgcttcacgctcaacaaccctgctgctggagaggaacgacccaagtctgatatgccatcgggtctgatcccgggacacaagcagagcgtgggactgttcctggagagagtgtacggcatcgaaactcaggagttgttctacaaactgctggaggaagccttcctgcctgacctcagggctgccactatgctggacaggaacgacggctgcgaatcagacatggcgctgtcgatgaaccgctacatcggcaactcgatcctgccgctgctgatcaaacacgcttacttctacaacgaagctgagaactacgccagtttattggatgccacgctacatactgtttataggttatcgaagaaccgcatgttaaccaagggtcaacgtgaagcggtgtcagacttcctagtggcgcttacttcagcgatgcagccctctatgttgctcaagctgctcaggaaattgacggtcgacgtgtctaaactgtccgagtatactactgtcgctcttaggctgctgacgctgcactacgagcgctgcgcgaagtactacggcagcacgggcgcggggcagggcgcgttcggcgcgtcgtcggacgaggagaagcgcctcaccatgatgctcttctccaacatcttcgactcgctcagcaagatggactacgagcccgagctcttcgggaaggcgctgccctgtcttattgctataggatgcgctctgcctcctgactactctctctcaaagaactatgatgatgagttttacggcaaagagcaagctgcaggtgacctagacaacccccaatacgaccctcagcccataaacacgtcctcagtagcattgaacaatgatctcaacacgatcgtacagaagttctcggaacattaccacgatgcgtgggctagtaggaagattgagaacggctgggtgtatggggagggctggtctgatagccagaagactcatcctaggctgaagccttataatatgcttaatgattatgaaaaagagcgttacaaggagccagtacgtgaatctctgaaggcacttctagccatcggttggtctgtagaacattcagaagtagacataccgagtaacaaccgaagctccatgagaaggcagtccaagtcgggaggccgccctcccgaaattgtgcagacagactcggcgactccgttcaactacaaccctcacccagtcgacatgaccaacttgacgctatcgagggagatgcagaacatggcggagaggctcgctgacaacgcacacgacatctgggcgaagaagaagaaggaagaactcgttactaatggaggtggcatccacccccaactagtaccctacgacctcctaacggacaaagaaaagaagaaagatcgagaacgttctcaagagttcctcaaataccttcaataccaagggtacaagctccaccggcccagcaaggcgccacaaagtgatacggaacaaaccactacgggggtagcaatagagttgagattcgcatactcgctcctcgagaaattgatccagtacatcgatagggccaccattaatatgaagcttttgaaaccttccactacgtttagtaggagaagtagttttaagactagtaccagggatattaagttcttttctaaggtggtgctgcctctaatggagaagtatttctcgacgcatcgtaactacttcatagctgtagctacggcgacgaataatgttggtgcagccagcctgaaggagaaagagatggtagctgctctgttctgtaagctggctagcttgcttagatctagactcgcagctttcggtcctgacgtccgcatcacagtccgctgtctccaagtgttggtgaagggcatcgacgccaagtccttagtgaagaactgccccgagttcatcaggacctccatgttgaccttcttcaacaatgtcgctgatgatgtagggcatacgatcatgaatttgcaggatggtaaatacgcacacctacgaggtacccacttgaagacatccacgtctctcggctatatcaacggagtactgctccccatactgacagccaaattcgaccatctggctaactgcgagtacggtgctgatctgttgttggacgagatacaagtggcgtcatacaagatgttgggctccctgtacgcgctcggcacggacgcttcgctcacacacgacagaaagtacctcaagactgagattgagagacataaacctgctttgggttcatgtctaggtgcgttcagttcgacattcccagtagcgttcctggagcctcacttgaacaaacacaaccagttctccttgctgaacaggatcgctgaccattctttggaagcccaagacataatgcagaaaatggaacaatgcatgccgacgttagaggcgatcttaggcgaggtggaccaattcgtggagtcagacaagacgtacaacgaagcgccgcatatcatcgatgtggtgttacctttactctgttcttacttgccgttctggtgggcacaggggcctgataatgttactcctactggcggaaaccacgtaacaatggtaacagcggaacacatgaaccagctcctcaagaatgttctgaagctcatcaaaaagaacatcggcaatgagaacgcgccgtggatgacccgcatagccacctacacccagcagatcatcatcaacagctccgaggagttgctgagggattccttcctgccgctcgctgaacgtgttcgcaagcgcacggacaatatgttccataaggaggagagcttgagagggtttattaagtcgtcaacagacgacacatctcaagtagagtcacagatacaagaagactggcagctgctggtcagagacatctactccttctacccgctactcatcaagtacgtcgacctgcagaggaaccactggctcaggaacaatgttccagaggcggaagagctgtacaaccacgtggccgaaatcttcaacatatggtcgaagagccagtacttcttgaaggaggaacagaacttcatctctgccaacgagattgataacatggtgctgattatgccaacagcaacaagaagagtgacagcagtaacagatggtactcctcaaggcggtggaaagaaaaagaagaagcaccgtgataagaaacgcgacaaagacaaggaagtccaagcgtccctaatggtagcttgtctgaagaggttgctaccagttggccttaacctattcgctggcagagaacaagaactggtgcagcattgtaaagacaggttcctgaaggtagggaccctcaagaaaatgtcagaacaagatgtggcagaattcgcgaagacccagctgacacttccagataaaatagatccggcagacgaaatgtcttggcaacattacttgtatagcaagttaggttcgaagagtaagagcaatataactgtggaaactgctgaaaataaagccaagattattgatgatactgttgaaaggatcgtcgctatgagtaaagtgcttttcggattgcatatgatcgaccatccccaacaaatgagtaagaacgtgtaccggtcggtggtgtccatacaacgcaagcgcgccgtcatcgcctgcttccgacaaacttcgctacattctctgccgagacaccgagcgtgtaacatcttcgctcgcacgtactacgagctctggttggaagaggagaacattggacaagaagttatgatagaagatcttactcaatcattcgaagacgcagaactgaagaagagtgacgtggtggaggaaggtgagaagcccgaccccctcacgcagctggtcaccaccttctgtcgcggcgccatgactgagaggtccggcgctttacaggaggatcccctatacatgtcttacgcacacatcatagcgaagtcctgtggagaagaagaggaagaagggggcggggaagaagaggaagggggtggagaagctgaggccgaggacgaaggcagagccagtatacacgaacaagagatggagaaacagaagcttctattccaccaagcgcgactggcagaccgcggtgttgccgagatggtgttgctgcatatctccgcgtctaaaggcctgcccagcgagatggtcatgaagacattacagctcggtattagtatactgagaggaggcaatattgatatacagatgggtatgttgaaccacttgaaagacaagaaagacgtgggattcttcacgtccatcgccggcctcatgaactcctgctcagtgctcgatcttgacgccttcgagaggaacaccaaagctgaaggtctgggcgtgggtctggaaggcgccgcaggagagaagaacatgcatgacgccgagttcacctgcgcactctttaggttcattcagctcacctgtgaaggacacaacttggactggcagaactacctgcgaactcaggccggtaacacgacgacagtgaacgtggtcatctgcaccgtcgactacctgctgcggctgcaggagtccatcatggacttctactggcactactctagcaaggaactgatcgacccggccggcaaagcgaatttcttcaaggccattggcgtggcttcccaagtattcaacaccctcactgaagtcatacagggaccttgtactcagaaccagcaggctttagctcactctaggttatgggacgctgtcggtggtttcttgttcctattctcccacatgcaggacaagttgtcgaagcactcgtcgcaggtggacctgctgaaggaactcctcaatctgcagaaggacatgatcaccatgatgctgtccatgcttgaaggaaatgttgttaatggtacaatcggcaagcaaatggtggacactctagtagaatcggcctccaacgtggaactgatcctgaaatacttcgacatgttcctcaagctgaaggacctgacttccagcgccagcttccaagagatagatgccaataacgacggctgggtgctgcccaaggacttcaaggagaagatggaacaacagaagagttatactcccgaagaaatcgagttcctcttagcttgctgcgagacgaaccacgacggcaagttagactacatcggtttctgcgaccgtttccacgagcctgccaaggagatcgggtttaacttggccgtgttactgactaacttgtctgaacatatgccgaacgagcctagattggctcgtttcctggagacggcgggttcagtcctgaactacttcgaaccattcctgggccgtatcgagatcatgggcggctctaagcgcatcgagcgagtctacttcgagatcaaggagtctaatatcgaacagtgggagaaaccgcaaattaaggaatccaaacgcgcgttcttctacagcatagtaacagaaggtggtgataaagagaaattagaagctttcgtgaacttctgtgaggacgccatctttgaaatgacgcacgcgtcgggactaatggcggcgtcggaggagtcggtgggagggaccaagaatagagaggccagctatatgtatatgggggatgatgatgatgagagagccggcaaagatccattccgtcgcggactccagtcagtgaaagacggcgtcgccacggcattttcttccttatcaccttccaacataaaggcgaaaatcgcagacatgcaacaaatgccaccagccgaactagcagtgggctttttcaaaatgttcttctatctattctattacttgggctatggagttctcgtcgttgtcaggtatatattcggtgtgctcttgggtctgatgcgaggtcctcagacggatgaaccgcctccggagccgacggaagaggagaaaatcggtcagttgagacacaggttgctagcgacacaaagttctcgtcatctcccggcgttgcctccagctgatgatacgggacagatgcaagtgtcggcattcggactcgatatcaccaaggaagacaatggacagatacaagtaaagccgcacgaatcacccagcacatccactccatcatcaggcgaggaggcggaggtgtcacccgacgagagcgccgaccacacggaggagcagagaccgccttctcttatcgacctgctcggtggagaacaagctaaaaagcaagctcaggagaggatggaagctcaagctgctcaacaagctgctatgtccgccattgaagctgaaagcaaaaaggcagtgcaagggcccgcgccatcagcgctatctcaagtggacctgtcccagtacacccggcgcgcagtctcgttcctagctcgcaacttctacaacctgaagtacgtggcgctcgtgctggccttctgtatcaacttcgtgctgctcttctataaggtatctaccctggacggtgaaggtggtgaaggttcgggtctgggtgatatcatcgccggtgggggttccggatccggggctggctctggcagtggagacggtagtggcgaatcaggagaagatgacgacgcgttagaagtagtacacatagacgaagacttcttctatatggaacacgtcatcaaaatggcggccgtgttgcactctatcgtgtctctggctatactcatcggatattatcatcttaaggtgccgctagctatcttcaaacgcgagaaggagatcgctcgtaaactggaattcgacggactgtacatcgctgaacagcctgaagacgacgacctcaagagccactgggacaaactcgttatatctgccaaatcattccccgtaaactactgggacaagttcgtgaagaagaaagttcgcgccaaatattcagagacatatgacttcgactccatctccaacatgttgggcatggagaagacttccttctccgcgcaagaagaagaaggcagcaaaggacttattcattacataatcaacatagactggcgctaccaagtgtggaaggcgggcgtgacgatcacagacaactcgttcctctactctctatggtacttctccttctccgtgatggggaacttcaacaacttcttcttcgccgcacatttgttggacgtggctgttgggtttaagaccctgaggactatcttgcagtctgtcacgcataatggaaaacagctggtattaacggtgatgctgctgactataatcgtgtacatctacacggtgatcgcgttcaacttcttccgcaagttctacgtgcaggaggaggacgacgaagtcaataggaactgccatgatatgttgacgtgcttcgtgttcaacttgtacaagggcgtgcgggcgggcggcggcatcggcgacgagctggagccgcctgatggagacgactccgaggtctaccgcatcatcttcgacatctccttcttcttcttcatcatcgtcatcctgctcgctatcctgcagggtttgatcatcgacgcgttcggagagctgcgtgaccagttggagtcggtgaaggaggacatggagtccaactgcttcatctgcggcatcaataaagactattttgataaagtgccgcacgggttcgacacacacgtgcagagggaacataatctagctaattacatgttcttcctcatgcatctcattaataaacccgatacggaatatacaggtcaagaaacctacgtatggaacatgtacacacaaagatgttgggacttcttccccgtgggagattgtttccgaaagcaatacgaagacctcatgggagaatag

SEQ ID NO: 130 - protein, 5134 aa, Heliothis virescens
  pXL-Hv2
MAEAEGGASEQDDVSFLRTEDMVCLSCTATGERVCLAAEGFGNRHCFLENIADKNIPPDLSQCVFVIEQALSVRALQELVTAAGSETGKGTGSGHRTLLYGNAILLRHLNSDMYLACLSTSSSQDKPAFDVGLQQHSQGEACWWTLHPASKQRSEGEKVRVGDDLILVSVATERYLHTTKENEVSIVNASFHVTHWSVQPYGTGISRMKYVGYVFGGDVLRFFHGGDECLTIPSTWTKDGGQNIVVYEGGSVMSQARSLWRLELARTKWAGGFINWYHPMRIRHITTGRYLGVNDQNELYLVSREEATTASCAFCLRQEKDDQKQVLEDKDLEVIGAPIIKYGDSTVIVQHSETGLWLSYKSYETKKEGVGKVEEKQAILHEEGKMDDGLDFSRSQEEESRTARVIRKCSSLFTKFINGLETLQENRRHSMFFASVNLGEMVMCLEDLINYFAQPDEDMEHEEKQNKFRALRNRQDLFQEEGILNLILEAIDKINVITSQGFLAGFLAGDESGQSWEMISGYLYQLLAAIIKGNHTNCAQFANSNRLNWLFSRLGSQASGEGTGMLDVLHCVLIDSPEALNMMRDEHIKVIISLLEKHGRDPKVLDVLCSLCVGNGVAVRSSQNNICDYLLPGKNLLLQTALVDHVSSVRPNIFVGRVEGSAVYRKWYFEVTMDHIEKTTHMIPHLRIGWANTTGYVPYPGGGEKWGGNGVGDDLYSYGFDGAYLWSGGRKTPVNRTHAEEPYIRKGDVIGCALDLTVPIINFMFNGVRVTGSFTNFNLEGMFFPVISCSSKLSCRFLLGGEHGRLRYAAPEGYSPLVESLLPQQILSLEPCFYFGNLSKRALAGPPLVQDDTAFVPTPVDTLQITLPTYVEQIRDKLAENIHEMWAMNKIEAGWMYGDQREDLHKIHPCLVPFERLPPAEKRYDIQLAVQTLKTILALGYYISLDKPPARIRNVRLPNEPFMQSNGYKPAPLDLSAVTLTPKMDELVDQLAENTHNLWARERIQQGWTYGLNEDSDMHRSPHLVPYPKVDDAIKKANRDTASETVRTLLVYGYMLDPPTGEQHEALLLEASKQKQADFRTYRAEKNYAVSSGKWYFEFEILTAGPMRVGWAHADMAPGMMLGQDENSWAFDGYNEEKVYSGNTESFGKQWAVGDVVGVFLDLIDKTISFSLNGELLMDALGGETTFADVQGDNFVPACTLGVGQKARLTYGQDVNTLKYFTTCGLQEGYEPFCVNMKRDVTHWYTKDQPIFENTDEMIDTRIDVTRIPAGSDTPPCLKISHNTFETMEKANWEFLRLSLPVICHNEFIDEAEKARRWVEIKDRQQILMKEAVEAQMPAHIDQIMRSGFTMNDIKGLHYEDNQEELPSSKMKRLPSRPPRKGSMTRGVTIQNYNNLQPGQVNGMHRSTSEAEMAKYDLGAQGLTPDDKKDKRGRSPFKFFRSKRGESSDRAKSRKSKTPDPFSDTEVSPERGARRPNPQIKVSQANQRYNGMNARPSRTNLYGSQVGLNMATPTQDRKQMTTSTLAQSATETVGNEIFDAECLKLINEYFYGVRIYPGQDPTHVYIGWVTTQYHLHSKDFNQSKVTKSSVIITDDYDRVVENVNRQSCYMVRADELYNEVMAEATAKGASQGMFIGCSVDTSTGSVSFTCEGKDTSFKFKMEPETKLFPAIFVEATSKEILQIELGRSATSLPLSAAVLPTSDKHVIPQFPPRLKVQCLKPHQWARVPNQSLQVHALKLSDIRGWSMLCEDAVSMLALHIPEEDRCIDILELIEMDKLLSFHSHTLTLYAALCYQSNYRAAHALCTHVDQKQLLYAIQSQYMSGPLRQGFYDLLIALHLESHATTMEACKNEFVIPLGPELKALYEEPDMGHSLRSLQTESVRPQMKMTDIAESITEISNLYSPYFPLEVVREFVMQALAEAVETNQVHNRDPVGGSNENLFLPLIKLVDRLLLVGMMRDEDVEKLLIMTNPETWDPSFDKEGKDEHRKGLLHMKMAEGAKLQMCYLLQHLNDIQLRHRVEAIIAFAHDFVGDLQTDQLRRYTEIKQSDLPSAVAAKKTREFRCPPREQMNAILSFKHLEEEDKENCPCGEELIARMNEFHDTLMAHVSLHALQEPDAAENQEPEAKPGAFGKLYNIINTVKELEEEAKAIEEPPKKTPEEKFRKVLIQTIVNWAEESQIETPKLVREMFSLLVRQYDAVGELIRALEKTYVINAKTKLDVAGMWVGLSQIRALLPVQMSQEEEELMRKRLWKLVNNHTFFQHPDLIRVLRVHENVMAVMMNTLGRRAQAQSDAQPSSQPVAEDNKEKDTSHEMVVACCRFLCYFCRTGRQNQKAMFDHFDFLLENSNILLSRPSLRGSTPLDVAYSSLMENTELALALREHYLEKIAVYLSRCGLQSNSELVEKGYPDLGWDPVEGERYLDFLRFCVWVNGESVEENANLVIRLLIRRPECLGPALRGEGEGLLKAIVDANKMSERIADRRKLREMEQEGDVNFSHPLPESDEDEDYIDTGAAILNFYCTLVDLLGRCAPDAGVIALGKNESLRARAILRSLVPLEDLQGVLSLRFTLNNPAAGEERPKSDMPSGLIPGHKQSVGLFLERVYGIETQELFYKLLEEAFLPDLRAATMLDRNDGCESDMALSMNRYIGNSILPLLIKHAYFYNEAENYASLLDATLHTVYRLSKNRMLTKGQREAVSDFLVALTSAMQPSMLLKLLRKLTVDVSKLSEYTTVALRLLTLHYERCAKYYGSTGAGQGAFGASSDEEKRLTMMLFSNIFDSLSKMDYEPELFGKALPCLIAIGCALPPDYSLSKNYDDEFYGKEQAAGDLDNPQYDPQPINTSSVALNNDLNTIVQKFSEHYHDAWASRKIENGWVYGEGWSDSQKTHPRLKPYNMLNDYEKERYKEPVRESLKALLAIGWSVEHSEVDIPSNNRSSMRRQSKSGGRPPEIVQTDSATPFNYNPHPVDMTNLTLSREMQNMAERLADNAHDIWAKKKKEELVTNGGGIHPQLVPYDLLTDKEKKKDRERSQEFLKYLQYQGYKLHRPSKAPQSDTEQTTTGVAIELRFAYSLLEKLIQYIDRATINMKLLKPSTTFSRRSSFKTSTRDIKFFSKVVLPLMEKYFSTHRNYFIAVATATNNVGAASLKEKEMVAALFCKLASLLRSRLAAFGPDVRITVRCLQVLVKGIDAKSLVKNCPEFIRTSMLTFFNNVADDVGHTIMNLQDGKYAHLRGTHLKTSTSLGYINGVLLPILTAKFDHLANCEYGADLLLDEIQVASYKMLGSLYALGTDASLTHDRKYLKTEIERHKPALGSCLGAFSSTFPVAFLEPHLNKHNQFSLLNRIADHSLEAQDIMQKMEQCMPTLEAILGEVDQFVESDKTYNEAPHIIDVVLPLLCSYLPFWWAQGPDNVTPTGGNHVTMVTAEHMNQLLKNVLKLIKKNIGNENAPWMTRIATYTQQIIINSSEELLRDSFLPLAERVRKRTDNMFHKEESLRGFIKSSTDDTSQVESQIQEDWQLLVRDIYSFYPLLIKYVDLQRNHWLRNNVPEAEELYNHVAEIFNIWSKSQYFLKEEQNFISANEIDNMVLIMPTATRRVTAVTDGTPQGGGKKKKKHRDKKRDKDKEVQASLMVACLKRLLPVGLNLFAGREQELVQHCKDRFLKVGTLKKMSEQDVAEFAKTQLTLPDKIDPADEMSWQHYLYSKLGSKSKSNITVETAENKAKIIDDTVERIVAMSKVLFGLHMIDHPQQMSKNVYRSVVSIQRKRAVIACFRQTSLHSLPRHRACNIFARTYYELWLEEENIGQEVMIEDLTQSFEDAELKKSDVVEEGEKPDPLTQLVTTFCRGAMTERSGALQEDPLYMSYAHIIAKSCGEEEEEGGGEEEEGGGEAEAEDEGRASIHEQEMEKQKLLFHQARLADRGVAEMVLLHISASKGLPSEMVMKTLQLGISILRGGNIDIQMGMLNHLKDKKDVGFFTSIAGLMNSCSVLDLDAFERNTKAEGLGVGLEGAAGEKNMHDAEFTCALFRFIQLTCEGHNLDWQNYLRTQAGNTTTVNVVICTVDYLLRLQESIMDFYWHYSSKELIDPAGKANFFKAIGVASQVFNTLTEVIQGPCTQNQQALAHSRLWDAVGGFLFLFSHMQDKLSKHSSQVDLLKELLNLQKDMITMMLSMLEGNVVNGTIGKQMVDTLVESASNVELILKYFDMFLKLKDLTSSASFQEIDANNDGWVLPKDFKEKMEQQKSYTPEEIEFLLACCETNHDGKLDYIGFCDRFHEPAKEIGFNLAVLLTNLSEHMPNEPRLARFLETAGSVLNYFEPFLGRIEIMGGSKRIERVYFEIKESNIEQWEKPQIKESKRAFFYSIVTEGGDKEKLEAFVNFCEDAIFEMTHASGLMAASEESVGGTKNREASYMYMGDDDDERAGKDPFRRGLQSVKDGVATAFSSLSPSNIKAKIADMQQMPPAELAVGFFKMFFYLFYYLGYGVLVVVRYIFGVLLGLMRGPQTDEPPPEPTEEEKIGQLRHRLLATQSSRHLPALPPADDTGQMQVSAFGLDITKEDNGQIQVKPHESPSTSTPSSGEEAEVSPDESADHTEEQRPPSLIDLLGGEQAKKQAQERMEAQAAQQAAMSAIEAESKKAVQGPAPSALSQVDLSQYTRRAVSFLARNFYNLKYVALVLAFCINFVLLFYKVSTLDGEGGEGSGLGDIIAGGGSGSGAGSGSGDGSGESGEDDDALEVVHIDEDFFYMEHVIKMAAVLHSIVSLAILIGYYHLKVPLAIFKREKEIARKLEFDGLYIAEQPEDDDLKSHWDKLVISAKSFPVNYWDKFVKKKVRAKYSETYDFDSISNMLGMEKTSFSAQEEEGSKGLIHYIINIDWRYQVWKAGVTITDNSFLYSLWYFSFSVMGNFNNFFFAAHLLDVAVGFKTLRTILQSVTHNGKQLVLTVMLLTIIVYIYTVIAFNFFRKFYVQEEDDEVNRNCHDMLTCFVFNLYKGVRAGGGIGDELEPPDGDDSEVYRIIFDISFFFFIIVILLAILQGLIIDAFGELRDQLESVKEDMESNCFICGINKDYFDKVPHGFDTHVQREHNLANYMFFLMHLINKPDTEYTGQETYVWNMYTQRCWDFFPVGDCFRKQYEDLMGE

SEQ ID NO: 131 - DNA, 23 bp, artificial sequence
  PCR primer TC-1
gatccgcggccgcgatcggtacc

SEQ ID NO: 132 - DNA, 14 bp, artificial sequence
  PCR primer TC-2
cgatcgcggccgcg

SEQ ID NO: 133 - DNA, 110 bp, artificial sequence
  TC-3
ccttttttttcagcgctataacttcgtataatgtatgctatacgaagttatccggcgcgccaacggaccgcccaaataaaacgaaaggctcagtcgaaagactgggcctt

SEQ ID NO: 134 - DNA, 110 bp, artificial sequence
  TC-4
tcgttttatctgttgtttgtcggtgaacgctctcctgagtaggacaaatccgccgggagcggatttgaacgttgcgaagcaacggcccggagggtggcgggcaggacgcc

SEQ ID NO: 135 - DNA, 108 bp, artificial sequence
  TC-5
cgccataaactgccaggcatcaaattaagcagaaggccatcctgacggatggccttttataacttcgtataatgtatgctatacgaagttatttaaactctctctctc

SEQ ID NO: 136 - DNA, 102 bp, artificial sequence
  TC-6
gagagagagagtttaaataacttcgtatagcatacattatacgaagttataaaaggccatccgtcaggatggccttctgcttaatttgatgcctggcagttt

SEQ ID NO: 137 - DNA, 110 bp, artificial sequence
  TC-7
atggcgggcgtcctgcccgccaccctccgggccgttgcttcgcaacgttcaaatccgctcccggcggatttgtcctactcaggagagcgttcaccgacaaacaacagata

SEQ ID NO: 138 - DNA, 107 bp, artificial sequence
  TC-8
aaacgaaaggcccagtctttcgactgagcctttcgttttatttgggcggtccgttggcgcgccggataacttcgtatagcatacattatacgaagttatagcgctga

SEQ ID NO: 139 - DNA, 18 bp, artificial sequence
  PCR primer TC-9
ccttttttttcagcgcta

SEQ ID NO: 140 - DNA, 18 bp, artificial sequence
  PCR primer TC-10
gagagagagtttaaataa

SEQ ID NO: 141 - DNA, 35 bp, artificial sequence
  PCR primer1 Drosophila Ryr
accaccttaattaattccgatttggaggcgctgcg

SEQ ID NO: 142 - DNA, 37 bp, artificial sequence
  PCR primer2 Drosophila Ryr
gcctccgtttaaacgaccgtccagtgccagtgtgaag

SEQ ID NO: 143 - DNA, 15429 bp, Heliothis virescens
  CDS (1)..(15429)
  pXL-Hv3
atggcggaagcagaggggggagcaagcgagcaagatgatgtttcattcttgcgtacggaagacatggtgtgcctgtcgtgcacagcgacaggagagagggtgtgcctggctgccgaaggtttcggcaaccggcactgcttcctggagaatattgccgacaagaacataccacctgatctgtcgcagtgtgtgtttgtcatcgaacaggcgctttcagtaagagctttacaggagttggtaacggctgcgggttctgaaactgggaaagaaaacttaggtaaaggtaccggttctggtcatcgtacgctactatacggcaatgctattcttttgcgacatcttaacagtgatatgtacctggcctgcctgtcgacatcatcatcccaggataagctggcctttgacgtgggtctgcaacagcactcccagggtgaagcctgctggtggaccctgcatcctgccagcaaacagagatccgagggtgagaaggtgcgagtcggagatgacttgattctggtctccgtggctactgagagatacttgcacacaacgaaagagaacgaagtatcgatagtgaacgcgtcgttccacgtgacccactggtcggtacagccctatggtactggtatatcgaggatgaagtatgtaggctatgtgttcggaggtgatgtgctgcggttcttccatggaggtgacgagtgtctcactatacctagtacctggacaaaggatggggggcaaaatatcgtagtctacgaaggaggttcagtgatgtctcaagcccggtctttatggcgcctggagctggctagaaccaagtgggccggaggtttcattaactggtaccaccctatgaggattcggcacatcactactggaagatatctcggagtaaacgaccagaatgagctgtatttagttagcagagaggaagccacaacagcttcctgtgccttctgcctgcgtcaggagaagggtgatcagaaacaagtgttagaagacaaggacttggaggtcataggcgcgcccatcatcaagtacggtgactccaccgtcattgtgcagcattccgagactggcttgtggctgtcttataagtcttacgaaacgaagaagaagggagtgggtaaagtagaagagaagcaagcgattctccacgaggaaggcaagatggacgacggcctcgacttctccaggtcacaggaggaagaatctaggactgctcgagttatcagaaagtgttcttcgctgttcactaagtttatcaatggtctggaaactctacaagagaaccgtcgtcactcgatgttcttcgcgtcagtgaacctgggcgagatggtgatgtgcctcgaggatctcatcaactacttcgcacaacccgatgaagatatggaacacgaagaaaagcaaaacaaattccgcgccctccgcaaccgtcaggacctgttccaagaggaaggcatactgaacctgatcctcgaagctatagtcaagatcaacgtcatcacgtctcaggggttcctggctggtttcctggcgggagacgaatctggacagagctgggaaatgatatctggatatttgtatcagttgttggcggcaataataaagggcaaccacacgaactgcgcgcagttcgcgaactcgaaccggctgaactggctgttctcgcgcctcggctcgcaggcctcgggcgagggcactggcatgctcgacgtgctgcactgcgtgctcatcgactcgcctgaagcgttgaatatgatgagggacgaacacataaaagtgataatctctctattagaaaagcacgggcgcgaccctaaagtactagatgtgttatgttcactctgcgtcggtaacggcgtcgcggtgcgctcgtcacagaacaacatctgtgactatttgctgcccggcaagaacctgttgctgcaaactgcgcttgtagatcacgtatctagtgtccgtccgaacatcttcgtgggtcgagtagaagggtcggcagtgtaccgcaaatggtacttcgaagtgactatggaccacatagagaagaccacacatatgatgccacatctacgcataggatgggctaacactactggctacgtcccatacccgggtggtggtgaaaagtggggaggtaacggcgtgggagacgacctgtactcgtacgggttcgacggcgcctacctctggtccggcgggaggaaaactcccgtcaataggactcatgctgaagagccttatattaggaaaggtgacgtgataggttgtgcgttagacctgacggtacccatcatcaacttcatgttcaacggagtgcgggtgacgggatccttcaccaacttcaatctggaaggcatgttcttcccggtcatcagctgctctagtaaattgagttgccggttcctgctgggcggggaacatggtagactccggcacgcggctccagaaggctactccccgctggtggagtctctcctgccgcagcagatcctcagcctggagccttgcttctacttcggcaacctgtccaagcgcgccctggctggacccccgctagtacaggacgatacggcttttgtgcctacacctgttgacactttacagattactctgcctacatatgtggaacaaatcagagacaagctagctgaaaatatacacgaaatgtgggctatgaataagatcgaagcaggctggatgtacggcgatcagagagaagacttgcacaagatccacccctgcctcgtgcccttcgagcgtctcccgcccgctgagaaacgatacgacatacaactcgctgtgcagacactcaagacaatcctggctctgggctactacatcagcttagataagcctccagcacgcatccgcaacgttcgtctgcccaacgaacctttcatgcagtccaacggctacaagccagcaccactcgacctgggtgctgtcaccctgacacccaagatggatgagctagtagaccagctggctgagaacacccacaacctttgggccagggagaggatacagcagggatggacttacggacttaatgaggactcggacatgcatcgatccccgcacctggtgccatacccgaaggttgacgatgccatcaagaaggccaacagggacacagcctcggagactgtgaggaccctgctggtctacgggtatatgctggacccgcctactggggagcagcatgaagcactcttgttggaagcgtcaaaacagaagcaagccgacttcagaacataccgcgctgagaagaactatgccgtcagctctgggaagtggtacttcgagtttgagatcctaacggctggacctatgagggtcggctgggctcacgctgatatggcaccaggaatgatgctcggacaagacgagaactcctgggcatttgatggttacaatgaggaaaaagtgtacagcggtaacactgagtctttcggcaagcaatgggctgttggtgacgtagtgggggtgttcctagatctcattgataagacgataagtttctcactcaacggtgagttattgatggatgctcttggcggagagactacgtttgctgatgtccagggtgacaactttgtacctgcttgcacgcttggtgtcggccaaaaagccaggttaacatacggtcaggacgtgaacacgctgaaatacttcacaacatgtggtctgcaggagggatatgaaccattctgtgtcaatatggagagagacgtgactcactggtacaccaaagaccagccgatcttcgagaatacggatgagatgatcgacaccagaatagatgtgaccaggataccagctggttcagatacacctccatgcctcaagatttcccacaacacgtttgagacgatggagaaagctaactgggagttcttacgtctctcactgcctgtcatctgccataacgagttcattgacgaggcagaaaaagccaggcgttgggtagaaatcaaggaccgccaacagatcctaatgaaagaggcagttgaagctcagatgcccgcccatattgaccagatcatgaggagcggtttcaccatgaacgatattaaaggtttgcactacgaagacaatcaggaagagttgcccagctccaagatgaagcgcctgccttcaaggccaccacgtaagggatccatgacaagaggtgttactatacaaaattacaataatttgcaaccaggtcaagtcaatggcatgcaccggtcgaccagtgaagctgaaatggccaagtatgacttgggagcgcaaggtttgacgcctgatgataagaaggacaagaggggacgatcgcctttcaagttcttcagaagcaagcgcggcgaaagcagtgatcgtgccaaatcccgtaaatccaaaactccagatcccttcagcgataccgaggtatcaccagaacgtggtgctcgaaggcctaaccctcagatcaaagtgtcacaggccaatcaaagatataacggcatgaacgcgcgtcctagcaggaccaacttgtatgggagccaagttggtttaaactcaaacgctcagatggcgacgcccacgcaagacaggaagcagatgacgacgagcactctcgcgcagtcggctacggaaactgtcggcaatgagatcttcgatgcagagtgcttgaagctcatcaatgagtacttttatggagtcaggatctacccaggtcaggacccaacacacgtgtacatcggctgggtgaccacccagtaccacttgcactctaaggacttcaaccagagcaaggtcaccaagtcctctgtcatcatcactgatgattacgatagggttgttgagaacgtaaaccggcagtcctgctacatggtgcgagctgacgagctatacaacgaggtgatggcggaagccacggccaagggcgcctcgcagggcatgttcatcggctgctccgtcgacacctccaccggcagcgtgtccttcacctgcgaggggaaggacaccagcttcaagttcaagatggaaccagaaacaaaactgttccccgcgatcttcgtagaagcgacctccaaggagatcctgcagatagagctgggcagatcagccaccagccttccactatcagccgctgtactaccaacgagtgataagcatgtcataccacagttcccaccgaggttgaaggtgcagtgcttgaaaccacatcagtgggctagggtaccgaaccaatccctacaagtccacgctctgaagttgtccgacatccgcggttggtcgatgctgtgtgaagacgcagtgtctatgctggctttgcacataccggaggaagatcgttgcatggacattttggagctgatagaaatggacaaacttttaagtttccattctcacaccctcacgttatacgctgctttatgttaccagagtaactacagggctgcccacgctctgtgcacgcacgtggaccagaagcagctgctgtacgcgatccagtcgcagtacatgtcgggcccgctgcgccaaggcttctacgatcttctcatagcgctgcatctcgagtcgcatgccaccaccatggaggcgtgtaagaacgagttcgtgatcccgctgggcccggagctgaaggcgctgtacgaggagcccgacatgggacactcgctgcgctcgctgcagaccgagagcgtgcggccgcagatgaagatgaccgatatcgctgaaagtataaccgagatcagcaacctatactcgccgtacttcccgctggaggtggtgcgcgagttcgtgatgcaggcgctggctgaagccgtggagaccaaccaggtgcacaaccgggatcctgtcggggggagcaatgagaacctgttcctgcctctaataaagctggtggaccgtcttctactagtcggcatgatgcgcgacgaggatgtggagaagctactcatcatgaccaaccctgagacgtgggacccctcgtttgataaagggggtaaagacgagcaccgcaaaggtctactccacatgaaaatggcggaaggcgctaagctgcagatgtgttacttactgcaacatctcaacgacatacagctgcggcacagggtcgaagctatcattgcgtttgcgcatgacttcgtcggtgatctacagactgatcagctcagacgttacacggaaatcaagcagtcggacttgccgagcgcggtggccgctaagaagaccagggagttccggtgtccgcctagagaacagatgaacgctatattgagtttcaagcacttagaggaggaggacaaggagaactgtccgtgcggcgaggagctgatcgcgcgcatgaacgagttccacgacaccctcatggcgcacgtctcgctgcacgcgctgcaggagcccgatgccgcggaaaatcaagaacctgaagcaaaaccgggggcattcggcaagctatacaacattatcaatacggtcaaggaattagaagaggaagctaaggcaatagaagagcctccgaagaagacgcctgaggagaagttccgtaaggtcctcatccagaccatagtgaactgggctgaggagtcgcagatagaaacacccaaactcgtcagagaaatgttcagccttcttgtccgccagtacgacgcagtaggcgagctgatccgcgctttagagaagacatacgtcatcaacgctaagaccaagttggatgtcgcggagatgtgggtggggctcagccagatccgagccctcctgccggtgcagatgagccaggaggaagaggaactcatgaggaagaggctctggaaacttgtgaacaaccacacgttcttccagcatccagacttaatcagagtgctccgcgtgcacgagaacgtgatggcggtgatgatgaacacgctcggccgccgcgcgcaggcgcagtccgacgcacagccctcctcgcagcctgtcgcagaggataacaaggagaaggacacatcacacgagatggtggtagcttgctgccgtttcctctgctacttctgccgcaccgggagacagaaccagaaggcaatgttcgaccacttcgacttcctcctggagaactccaacatcttgctgtccagaccttcgctgagaggatccacgcctctagacgtggcttattccagtcttatggagaacactgaactggcgctggctttgagagagcactacctggagaagatagcagtatacctgtcccgttgtggtctgcagagcaactcggagctggtggagaaggggtaccctgacctcggctgggatccggtcgagggggagcggtatcttgacttcctgaggttctgtgtttgggtaaacggcgaaagcgtagaagaaaacgcgaatctagtgatccgtctcctgatccgtcgtccggagtgcctcgggccggcgctgcgcggcgagggcgagggcctgctgaaggctatcgtcgacgccaacaagatgagcgagaggatcgccgacaggaggaagctcagggaaatggagcaggaaggagatgttaacttcagccaccctctcccggagtcagatgaggatgaggactacatagacacgggggccgccatcttgaacttctactgtacattggtagatctgctcggaagatgtgctcctgatgctggcgttattgctctcggcaagaacgagtctctccgtgcccgcgctatcctgcggtcgctggtgccgctggaggacctgcagggagtgctgagcctgcgcttcacgctcaacaaccctgctgctggagaggaacgacccaagtctgatatgccatcgggtctgatcccgggacacaagcagagcgtgggactgttcctggagagagtgtacggcatcgaaactcaggagttgttctacaaactgctggaggaagccttcctgcctgacctcagggctgccactatgctggacaggaacgacggctgcgaatcagacatggcgctgtcgatgaaccgctacatcggcaactcgatcctgccgctgctgatcaaacacgcttacttctacaacgaagctgagaactacgccagtttattggatgccacgctacatactgtttataggttatcgaagaaccgcatgttaaccaagggtcaacgtgaagcggtgtcagacttcctagtggcgcttacttcagcgatgcagccctctatgttgctcaagctgctcaggaaattgacggtcgacgtgtctaaactgtccgagtatactactgtcgctcttaggctgctgacgctgcactacgagcgctgcgcgaagtactacggcagcacgggcgcggggcagggcgcgttcggcgcgtcgtcggacgaggagaagcgcctcaccatgatgctcttctccaacatcttcgactcgctcagcaagatggactacgagcccgagctcttcgggaaggcgctgccctgtcttattgctataggatgcgctctgcctcctgactactctctctcaaagaactatgatggtgagttttacggcaaagagcaagctgcaggtgacctagacaacccccaatacgaccctcagcccataaacacgtcctcagtagcattgaacaatgatctcaacacgatcgtacagaagttctcggaacattaccacgatgcgtgggctagtaggaagattgagaacggctgggtgtatggggagggctggtctgatagccagaagactcatcctaggctgaagccttataatatgcttaatgattatgaaaaagagcgttacaaggagccagtacgtgaatctctgaaggcacttctagccatcggttggtctgtagaacattcagaagtagacataccgagtaacaaccgaagctccatgagaaggcagtccaagtcgggaggccgccctcccgaaattgtgacagactcggcgactccgttcaactacaaccctcacccagtcgacatgaccaacttgacgctatcgagggagatgcagaacatggcggagaggctcgctgacaacgcacacgacatctgggcgaagaagaagaaggaagaactcgttactaatggaggtggcatccacccccaactagtaccctacgacctcctaacggacaaagaaaagaagaaagatcgagaacgttctcaagagttcctcaaataccttcaataccaagggtacaagctccaccggcccagcaaggcgccacaaagtgatacggaacaaaccactacgggggtagcaatagagttgagattcgcatactcgctcctcgagaaattgatccagtacatcgatagggccaccattaatatgaagcttttgaaaccttccactacgtttagtaggagaagtagttttaagactagtaccagggatattaagttcttttctaaggtggtgctgcctctaatggagaagtatttctcgacgcatcgtaactacttcatagctgtagctacggcgacgaataatgttggtgcagccagcctgaaggagaaagagatggtagctgctctgttctgtaagctggctagcttgcttagatctagactcgcagctttcggtcctgacgtccgcatcacagtccgctgtctccaagtgttggtgaagggcatcgacgccaagtccttagtgaagaactgccccgagttcatcaggacctccatgttgaccttcttcaacaatgtcgctgatgatgtagggcatacgatcatgaatttgcaggatggtaaatacgcacacctacgaggtacccacttgaagacatccacgtctctcggctatatcaacggagtactgctccccatactgacagccaaattcgaccatctggctaactgcgagtacggtgctgatccgttgttggacgagatacaagtggcgtcatacaagatgttgggctccctgtacgcgctcggcacggacgcttcgctcacacacgacagaaagtacctcaagactgagattgagagacataaacctgctttgggttcatgtctaggtgcgttcagttcgacattcccggtagcgttcctggagcctcacttggacaaacacaaccagttctccttgctgaacaggatcgctgaccattctttggaagcccaagacataatgcagaaaatggaacaatgcatgccgacgttagagacgatcttaggcgaggtggaccaattcgtggagtcagacaagacgtacaacgaagcgccgcatatcatcgatgtggtgttgcctttactctgttcttacttgccgttctggtgggcacaggggcctgataatgttactcctactggcggaaaccacgtaacaatggtaacagcggaacacatgaaccagctcctcaagaatgttctgaagctcatcaaaaagaacatcggcaatgagaacgcgccgtggatgacccgcatagccacctacacccagcagatcatcatcaacagctccgaggagttgctgagggattccttcctgccgctcgctgaacgtgttcgcaagcgcacggacaatatgttccataaggaggagagcttgagagggtttattaagtcgtcaacagacgacacatctcaagtagagtcacagatacaagaagactggcagctgctggtcagagacatctactccttctacccgctactcatcaagtacgtcgacctgcagaggaaccactggctcaggaacaatgttccagaggcggaagagctgtacaaccacgtggccgaaatcttcaacatatggtcgaagagccagtacttcttgaaggaggaacagaacttcatctctgccaacgagattgataacatggtgctgattatgccaacagcaacaagaagagtgacagcagtaacagatggtactcctcaaggcggtggaaagaaaaagaagaagcaccgtgataagaaacgcgacaaagacaaggaagtccaagcgtccctaatggtagcttgtctgaagaggttgctaccagttggccttaacctattcgctggcagagaacaagaactggtgcagcattgtaaagacaggttcctgaaggtagggaccctcaagaaaatgtcagaacaagatgtggcagaattcgcgaagacccagctgacacttccagataaaatagatccggcagacgaaatgtcttggcaacattacttgtatagcaagttaggttcgaagagtaagagcaatataactgtggaaactgctgaaaataaagccaagattattgatgatactgttgaaaggatcgtcgctatgagtaaagtgcttttcggattgcatatgatcgaccatccccaacaaatgagtaagaacgtgtaccggtcggtggtgtccatacaacgcaagcgcgccgtcatcgcctgcttccgacaaacttcgctacattctctgccgagacaccgagcgtgtaacatcttcgctcgcacgtactacgagctctggttggaagaggagaacattggacaagaagttatgatagaagatcttactcaatcattcgaagacgcagaactgaagaagagtgacgtggtggaggaaggtgagaagcccgaccccctcacgcagctggtcaccaccttctgtcgcggcgccatgactgagaggtccggcgctttacaggaggatcccctatacatgtcttacgcacacatcatagcgaagtcctgtggagaagaagaggaagaagggggcggggaagaagaggaagggggtggagaagctgaggccgaggacgaaggcagagccagtatacacgaacaagagatggagaaacagaagcttctattccaccaagcgcgactggcagaccgcggtgttgccgagatggtgttgctgcatatctccgcgtctaaaggcctgcccagcgagatggtcatgaagacattacagctcggtattagtatactgagaggaggcaatattgatatacagatgggtatgttgaaccacttgaaagacaagaaagacgtgggattcttcacgtccatcgccggcctcatgaactcctgctcagtgctcgatcttgacgccttcgagaggaacaccaaagctgaaggtctgggcgtgggtctggaaggcgccgcaggagagaagaacatgcatgacgccgagttcacctgcgcactctttaggttcattcagctcacctgtgaaggacacaacttggactggcagaactacctgcgaactcaggccggtaacacggcggcagtgaacgtggtcatctgcaccgtcgactacctgctgcggctgcaggagtccatcatggacttctactggcactactctagcaaggaactgatcgacccggccggcaaggcgaatttcttcaaggccattggcgtggcttcccaagtattcaacaccctcactgaagtcatacagggaccttgtactcagaaccagcaggctttagctcactctaggttatgggacgctgtcggtggtttcttgttcctattctcccacatgcaggacaagttgtcgaagcactcgtcgcaggtggacctgctgaaggaactcctcaatctgcagaaggacatgatcaccatgatgctgtccatgcttgaaggaaatgttgttaatggtacaatcggcaagcaaatggtggacactctagtagaatcggcctccaacgtggaactgatcctgaaatacttcgacatgttcctcaagctgaaggacctgacttccagcgccagcttccaagagatagatgccaataacgacggctgggtgctgcccaaggacttcaaggagaagatggaacaacagaagagttatactcccgaagaaatcgagttcctcttagcttgctgcgagacgaaccacgacggcaagttagactacatcggtttctgcgaccgtttccacgagcctgccaaggagatcgggtttaacttggccgtgttactgactaacttgtctgaacatatgccgaacgagcctagattggctcgtttcctggagacggcgggttcagtcctgaactacttcgaaccattcctgggccgtatcgagatcatgggcggctctaagcgcatcgagcgagtctacttcgagatcaaggagtctaatatcgaacagtgggagaaaccgcaaattaaggaatccaaacgcgcgttcttctacagcatagtaacagaaggtggtgataaagagaaattagaagctttcgtgaacttctgtgaggacgccatctttgaaatgacgcacgcgtcgggactaatggcggcgtcggaggagtcggtgggagggaccaagaatagagaggccagctatatgtatatgggggatgatgatgatgagagagccggcaaagatccattccgtcgcggactccagtcagtgaaagacggcgtcgccacggcattttcttccttatcaccttccaacataaaggcgaaaatcgcagacatgcaacaaatgccaccagccgaactagcagtgggctttttcaaaatgttcttctatctattctattacttgggctatggagttctcgtcgttgtcaggtatatattcggtgtgctcttgggtctgatgcgaggtcctcagacggatgaaccgcctccggagccgacggaagaggagaaaatcggtcagttgagacacaggttgctagcgacacaaagttctcgtcatctcccggcgttgcctccagctgatgatacgggacagatgcaagtgtcggcattcggactcgatatcaccaaggaaggcaatggacagatacaagtaaagccgcacgaatcacccagcacatccactccatcatcaggcgaggaggcggaggtgtcacccgacgagagcgccgaccacacggaggagcagagaccgccttctcttatcgacctgctcggtggagaacaagctaaaaagcaagctcaggagaggatggaagctcaagctgctcaacaagctgctatgtccgccattgaagctgaaagcaaaaaggcagtgcaagggcccgcgccatcagcgctatctcaagtggacctgtcccagtacacccggcgcgtagtctcgttcctagctcgcaacttctacaacctgaagtacgtggcgctcgtgctggccttctgtatcaacttcgtgctgctcttctataaggtatctaccctggacggtgaaggtggtgaaggttcgggtctgggtgatatcatcgccggtgggggttccggatccggggctggctctggcagtggagacggtagtggcgaatcaggagaagatgacgacgcgttagaagtagtacacatagacgaagacttcttctatatggaacacgtcatcaaaatggcggccgtgttgcactctatcgtgtctctggctatactcatcggatattatcatcttaaggtgccgctagctatcttcaaacgcgagaaggagatcgctcgtaaactggaattcgacggactgtacatcgctgaacagcctgaagacgacgacctcaagagccactgggacaaactcgttatatctgccaaatcattccccgtaaactactgggacaagttcgtgaagaagaaagttcgcgccaaatattcagagacatatgacttcgactccatctccaacatgttgggcatggagaagacttccttctccgcgcaagaagaagaaggcagcaaaggacttattcattacataatcaacatagactggcgctaccaagtgtggaaggcgggcgtgacgatcacagacaactcgttcctctactctctatggtacttctccttctccgtgatggggaacttcaacaacttcttcttcgccgcacatttgttggacgtggctgttgggtttaagaccctgaggactatcttgcagtctgtcacgcataatggaaaacagctggtattaacggtgatgctgctgactataatcgtgtacatctacacggtgatcgcgttcaacttcttccgcaagttctacgtgcaggaggaggacgacgaagtcaataggaactgccatgatatgttgacgtgcttcgtgttcaacttgtacaagggcgtgcgggcgggcggcggcatcggcgacgagctggagccgcctgatggagacgactccgaggtctaccgcatcatcttcgacatctccctcttcttcttcatcatcgtcatcctgctcgctatcctgcagggtttgatcatcgacgcgttcggagagctgcgtgaccagttggagtcggtgaaggaggacatggagtccaactgcttcatctgcggcatcaataaagactattttgataaagtgccgcacgggttcgacacacacgtgcagagggaacataatctagctaattacatgttcttcctcatgcatctcattaataaacccgatacggaatatacaggtcaagaaacctacgtatggaacatgtacacacaaagatgttgggacttcttccccgtgggagattgtttccgaaagcaatacgaagacctcatgggagaatag

SEQ ID NO: 144 - protein, 5142 aa, Heliothis virescens
  pXL-Hv3
MAEAEGGASEQDDVSFLRTEDMVCLSCTATGERVCLAAEGFGNRHCFLENIADKNIPPDLSQCVFVIEQALSVRALQELVTAAGSETGKENLGKGTGSGHRTLLYGNAILLRHLNSDMYLACLSTSSSQDKLAFDVGLQQHSQGEACWWTLHPASKQRSEGEKVRVGDDLILVSVATERYLHTTKENEVSIVNASFHVTHWSVQPYGTGISRMKYVGYVFGGDVLRFFHGGDECLTIPSTWTKDGGQNIVVYEGGSVMSQARSLWRLELARTKWAGGFINWYHPMRIRHITTGRYLGVNDQNELYLVSREEATTASCAFCLRQEKGDQKQVLEDKDLEVIGAPIIKYGDSTVIVQHSETGLWLSYKSYETKKKGVGKVEEKQAILHEEGKMDDGLDFSRSQEEESRTARVIRKCSSLFTKFINGLETLQENRRHSMFFASVNLGEMVMCLEDLINYFAQPDEDMEHEEKQNKFRALRNRQDLFQEEGILNLILEAIVKINVITSQGFLAGFLAGDESGQSWEMISGYLYQLLAAIIKGNHTNCAQFANSNRLNWLFSRLGSQASGEGTGMLDVLHCVLIDSPEALNMMRDEHIKVIISLLEKHGRDPKVLDVLCSLCVGNGVAVRSSQNNICDYLLPGKNLLLQTALVDHVSSVRPNIFVGRVEGSAVYRKWYFEVTMDHIEKTTHMMPHLRIGWANTTGYVPYPGGGEKWGGNGVGDDLYSYGFDGAYLWSGGRKTPVNRTHAEEPYIRKGDVIGCALDLTVPIINFMFNGVRVTGSFTNFNLEGMFFPVISCSSKLSCRFLLGGEHGRLRHAAPEGYSPLVESLLPQQILSLEPCFYFGNLSKRALAGPPLVQDDTAFVPTPVDTLQITLPTYVEQIRDKLAENIHEMWAMNKIEAGWMYGDQREDLHKIHPCLVPFERLPPAEKRYDIQLAVQTLKTILALGYYISLDKPPARIRNVRLPNEPFMQSNGYKPAPLDLGAVTLTPKMDELVDQLAENTHNLWARERIQQGWTYGLNEDSDMHRSPHLVPYPKVDDAIKKANRDTASETVRTLLVYGYMLDPPTGEQHEALLLEASKQKQADFRTYRAEKNYAVSSGKWYFEFEILTAGPMRVGWAHADMAPGMMLGQDENSWAFDGYNEEKVYSGNTESFGKQWAVGDVVGVFLDLIDKTISFSLNGELLMDALGGETTFADVQGDNFVPACTLGVGQKARLTYGQDVNTLKYFTTCGLQEGYEPFCVNMERDVTHWYTKDQPIFENTDEMIDTRIDVTRIPAGSDTPPCLKISHNTFETMEKANWEFLRLSLPVICHNEFIDEAEKARRWVEIKDRQQILMKEAVEAQMPAHIDQIMRSGFTMNDIKGLHYEDNQEELPSSKMKRLPSRPPRKGSMTRGVTIQNYNNLQPGQVNGMHRSTSEAEMAKYDLGAQGLTPDDKKDKRGRSPFKFFRSKRGESSDRAKSRKSKTPDPFSDTEVSPERGARRPNPQIKVSQANQRYNGMNARPSRTNLYGSQVGLNSNAQMATPTQDRKQMTTSTLAQSATETVGNEIFDAECLKLINEYFYGVRIYPGQDPTHVYIGWVTTQYHLHSKDFNQSKVTKSSVIITDDYDRVVENVNRQSCYMVRADELYNEVMAEATAKGASQGMFIGCSVDTSTGSVSFTCEGKDTSFKFKMEPETKLFPAIFVEATSKEILQIELGRSATSLPLSAAVLPTSDKHVIPQFPPRLKVQCLKPHQWARVPNQSLQVHALKLSDIRGWSMLCEDAVSMLALHIPEEDRCMDILELIEMDKLLSFHSHTLTLYAALCYQSNYRAAHALCTHVDQKQLLYAIQSQYMSGPLRQGFYDLLIALHLESHATTMEACKNEFVIPLGPELKALYEEPDMGHSLRSLQTESVRPQMKMTDIAESITEISNLYSPYFPLEVVREFVMQALAEAVETNQVHNRDPVGGSNENLFLPLIKLVDRLLLVGMMRDEDVEKLLIMTNPETWDPSFDKGGKDEHRKGLLHMKMAEGAKLQMCYLLQHLNDIQLRHRVEAIIAFAHDFVGDLQTDQLRRYTEIKQSDLPSAVAAKKTREFRCPPREQMNAILSFKHLEEEDKENCPCGEELIARMNEFHDTLMAHVSLHALQEPDAAENQEPEAKPGAFGKLYNIINTVKELEEEAKAIEEPPKKTPEEKFRKVLIQTIVNWAEESQIETPKLVREMFSLLVRQYDAVGELIRALEKTYVINAKTKLDVAEMWVGLSQIRALLPVQMSQEEEELMRKRLWKLVNNHTFFQHPDLIRVLRVHENVMAVMMNTLGRRAQAQSDAQPSSQPVAEDNKEKDTSHEMVVACCRFLCYFCRTGRQNQKAMFDHFDFLLENSNILLSRPSLRGSTPLDVAYSSLMENTELALALREHYLEKIAVYLSRCGLQSNSELVEKGYPDLGWDPVEGERYLDFLRFCVWVNGESVEENANLVIRLLIRRPECLGPALRGEGEGLLKAIVDANKMSERIADRRKLREMEQEGDVNFSHPLPESDEDEDYIDTGAAILNFYCTLVDLLGRCAPDAGVIALGKNESLRARAILRSLVPLEDLQGVLSLRFTLNNPAAGEERPKSDMPSGLIPGHKQSVGLFLERVYGIETQELFYKLLEEAFLPDLRAATMLDRNDGCESDMALSMNRYIGNSILPLLIKHAYFYNEAENYASLLDATLHTVYRLSKNRMLTKGQREAVSDFLVALTSAMQPSMLLKLLRKLTVDVSKLSEYTTVALRLLTLHYERCAKYYGSTGAGQGAFGASSDEEKRLTMMLFSNIFDSLSKMDYEPELFGKALPCLIAIGCALPPDYSLSKNYDGEFYGKEQAAGDLDNPQYDPQPINTSSVALNNDLNTIVQKFSEHYHDAWASRKIENGWVYGEGWSDSQKTHPRLKPYNMLNDYEKERYKEPVRESLKALLAIGWSVEHSEVDIPSNNRSSMRRQSKSGGRPPEIVTDSATPFNYNPHPVDMTNLTLSREMQNMAERLADNAHDIWAKKKKEELVTNGGGIHPQLVPYDLLTDKEKKKDRERSQEFLKYLQYQGYKLHRPSKAPQSDTEQTTTGVAIELRFAYSLLEKLIQYIDRATINMKLLKPSTTFSRRSSFKTSTRDIKFFSKVVLPLMEKYFSTHRNYFIAVATATNNVGAASLKEKEMVAALFCKLASLLRSRLAAFGPDVRITVRCLQVLVKGIDAKSLVKNCPEFIRTSMLTFFNNVADDVGHTIMNLQDGKYAHLRGTHLKTSTSLGYINGVLLPILTAKFDHLANCEYGADPLLDEIQVASYKMLGSLYALGTDASLTHDRKYLKTEIERHKPALGSCLGAFSSTFPVAFLEPHLDKHNQFSLLNRIADHSLEAQDIMQKMEQCMPTLETILGEVDQFVESDKTYNEAPHIIDVVLPLLCSYLPFWWAQGPDNVTPTGGNHVTMVTAEHMNQLLKNVLKLIKKNIGNENAPWMTRIATYTQQIIINSSEELLRDSFLPLAERVRKRTDNMFHKEESLRGFIKSSTDDTSQVESQIQEDWQLLVRDIYSFYPLLIKYVDLQRNHWLRNNVPEAEELYNHVAEIFNIWSKSQYFLKEEQNFISANEIDNMVLIMPTATRRVTAVTDGTPQGGGKKKKKHRDKKRDKDKEVQASLMVACLKRLLPVGLNLFAGREQELVQHCKDRFLKVGTLKKMSEQDVAEFAKTQLTLPDKIDPADEMSWQHYLYSKLGSKSKSNITVETAENKAKIIDDTVERIVAMSKVLFGLHMIDHPQQMSKNVYRSVVSIQRKRAVIACFRQTSLHSLPRHRACNIFARTYYELWLEEENIGQEVMIEDLTQSFEDAELKKSDVVEEGEKPDPLTQLVTTFCRGAMTERSGALQEDPLYMSYAHIIAKSCGEEEEEGGGEEEEGGGEAEAEDEGRASIHEQEMEKQKLLFHQARLADRGVAEMVLLHISASKGLPSEMVMKTLQLGISILRGGNIDIQMGMLNHLKDKKDVGFFTSIAGLMNSCSVLDLDAFERNTKAEGLGVGLEGAAGEKNMHDAEFTCALFRFIQLTCEGHNLDWQNYLRTQAGNTAAVNVVICTVDYLLRLQESIMDFYWHYSSKELIDPAGKANFFKAIGVASQVFNTLTEVIQGPCTQNQQALAHSRLWDAVGGFLFLFSHMQDKLSKHSSQVDLLKELLNLQKDMITMMLSMLEGNVVNGTIGKQMVDTLVESASNVELILKYFDMFLKLKDLTSSASFQEIDANNDGWVLPKDFKEKMEQQKSYTPEEIEFLLACCETNHDGKLDYIGFCDRFHEPAKEIGFNLAVLLTNLSEHMPNEPRLARFLETAGSVLNYFEPFLGRIEIMGGSKRIERVYFEIKESNIEQWEKPQIKESKRAFFYSIVTEGGDKEKLEAFVNFCEDAIFEMTHASGLMAASEESVGGTKNREASYMYMGDDDDERAGKDPFRRGLQSVKDGVATAFSSLSPSNIKAKIADMQQMPPAELAVGFFKMFFYLFYYLGYGVLVVVRYIFGVLLGLMRGPQTDEPPPEPTEEEKIGQLRHRLLATQSSRHLPALPPADDTGQMQVSAFGLDITKEGNGQIQVKPHESPSTSTPSSGEEAEVSPDESADHTEEQRPPSLIDLLGGEQAKKQAQERMEAQAAQQAAMSAIEAESKKAVQGPAPSALSQVDLSQYTRRVVSFLARNFYNLKYVALVLAFCINFVLLFYKVSTLDGEGGEGSGLGDIIAGGGSGSGAGSGSGDGSGESGEDDDALEVVHIDEDFFYMEHVIKMAAVLHSIVSLAILIGYYHLKVPLAIFKREKEIARKLEFDGLYIAEQPEDDDLKSHWDKLVISAKSFPVNYWDKFVKKKVRAKYSETYDFDSISNMLGMEKTSFSAQEEEGSKGLIHYIINIDWRYQVWKAGVTITDNSFLYSLWYFSFSVMGNFNNFFFAAHLLDVAVGFKTLRTILQSVTHNGKQLVLTVMLLTIIVYIYTVIAFNFFRKFYVQEEDDEVNRNCHDMLTCFVFNLYKGVRAGGGIGDELEPPDGDDSEVYRIIFDISLFFFIIVILLAILQGLIIDAFGELRDQLESVKEDMESNCFICGINKDYFDKVPHGFDTHVQREHNLANYMFFLMHLINKPDTEYTGQETYVWNMYTQRCWDFFPVGDCFRKQYEDLMGE

SEQ ID NO: 145 - DNA, 15303 bp, Heliothis virescens
  CDS (1)..(15300)
  pXL-Hv6
atggcggaagcagaggggggagcaagcgagcaagatgatgtttcattcttgcgtacggaagacatggtgtgcctgtcgtgcacagcgacaggagagagggtgtgcctggctgccgaaggtttcggcaaccggcactgcttcctggagaatattgccgacaagaacataccgcctgatctgtcgcagtgtgtgtttgtcatcgaacaggcgctttcagtaagagctttacaagagttggtaacggctgcgggttctgaaactgggaaagaaaacttaggtaaaggtaccggttctggtcatcgtacgctattatacggcaatgctattcttttgcgacatcttaacagtgatatgtacctggcctgcctgtcgacatcatcatcccaagataagctggcctttgacgtgggtctgcaacagcactcccagggtgaagcctgctggtggaccctgcatcctgccagcaaacagagatccgagggtgagaaggtgcgagtcggagatgacttgattcttgtctccgtggccactgagagatacttgcacacaacgaaagagaacgaagtatcgatagtgaacgcgtcgttccacgtgacccactggtcggtacagccctatggcactggtatatcgaggatgaagtatgtaggctatgtgttcggaggtgatgtgctgaggttcttccatggaggtgacgagtgtctcactatacctagtacctggacaaaggatggggggcaaaatatcgtagtgtacgaaggaggttcagtgatgtctcaagcccgttctctttggcgcctggagctggctagaaccaagtgggccggaggtttcattaactggtaccatcctatgaggattcggcacatcactactggaagatatcttggagttaacgaccagaatgaactgtatttagttagcagagaggaagccacaacagcttcttgtgccttctgcctgcgtcaggagaaggatgatcagaagcaagtgttagaagacaaggacttggaggtcataggcgctcccatcatcaaatatggtgactccaccgtcattgtgcagcattccgagactggcttgtggctgtcttataagtcttacgaaacgaagaagaagggagtgggtaaagtagaagagaagcaagcgattctccacgaggaaggcaagatggacgatggcctcgacttctccaggtcacaggaggaagaatctaggactgctcgagttatcaggaagtgttcttcgctgttcactaagtttatcaatgggcttgaaactctacaagagaaccgtcgtcactcgatgttcttcgcgtcagtgaacctgggtgagatggtgatgtgcctcgaggatctcatcaactacttcgcacagccagatgaagatatggaacacgaagaaaagcaaaacaaattccgcgccctccgcaaccgtcaggacctgttccaagaggaaggcatactgaacctgatcctcgaagctatagacaagatcaacgtcatcacatcccaggggttcctcgctggtttcctggcaggagacgaatctggacaaagctgggaaatgatatctggatatttgtatcagttgctggcggcaataataaaaggcaaccacacgaactgcgcgcagttcgcgaactcgaaccggctcaactggctgttctcgcgcctcggctcgcaggcctcgggcgagggcaccggcatgctcgacgtgctgcactgcgtcctcatagactcgcctgaagcgctcaatatgatgcgggacgaacacataaaagtgataatttctctattagaaaagcatgggcgcgacccaaaagtactagatgtgctatgttcactctgcgtcggtaacggcgtcgcggtgcgctcgtcacagaacaacatctgcgactacttgctgcccggcaagaacctgttgctgcaaactgcgcttgtagatcacgtatctagtgtccgtccgaacatcttcgtgggtcgagtagaaggttcagccgtgtaccgcaaatggtacttcgaagtgactatggaccacatagagaagaccacacatatgatgccacatctacgcataggatgggctaacactactggctacgtcccatacccgggcggtggcgagaagtggggaggtaacggcgtgggagacgacctgtactcgtacgggctcgacggcgcctacctctggtccggcgggaggaagactcccgttaataggactcatgctgaagagccttatattaggaaaggtgacgtgataggttgtgcattggacctgacggtacccataatcaacttcatgttcaacggagtgcgggtgacgggatccttcaccaacttcaacctggaaggcatgttcttcccggtcatcagttgctctagtaaattgagttgtcggttcctgctaggcggggaacacggtagactccggtacgcggctccagaaggctactccccactggtggagtctctcctgccgcagcagatcctcagcctggagccgtgcttctacttcggcaacctgtccaagcgggccctggctggacccccgctagtacaggacgatacggcttttgtgcctacacctgttgatactttacagattactctgcctacatatgtggaacaaattagagataagctagctgaaaatatacacgaaatgtgggctatgaataagatcgaagcaggctggatgtacggcgaccagagagaagacttgcacaagatccacccctgcctcgtgcccttcgagcgtctcccgcctgctgagaaacgatacgacatacaactcgctgtgcagacactcaagactatcctggctctgggctactacatcagcttagataagcctccagcacgcatccgcaacgttcgtctgcccaacgaacctttcatgcagtccaacggctacaagccagcaccactcgatctgagtgctgtcaccctgacacccaagatggatgagctagtagaccagctggctgagaacacacacaacctttgggccagggagaggatacagcagggatggacttacggacttaatgaggactcggacatgcatcgttccccgcacctggtgccgtacccgaaggttgacgatgccatcaagaaagccaacagggacacagcctcggagactgtgaggaccctgctggtctacgggtatatgctggacccgcctactggggagcagcatgaagcactcttgttggaagcgtcaaaacagaagcaagcagacttcagaacataccgcgctgaaaagaactatgccgtcagctctgggaagtggtacttcgagtttgagatcctaacggctggacctatgagggtcggctgggctcacgctgatatggcaccaggaatgatgctcggacaagatgagaactcttgggcatttgatggttacaatgaggaaaaagtgtacagcggtaacactgagtctttcggcaagcaatgggctgttggtgacgtagtgggggtgttcctagatctcattgataagacgataagtttctcactcaacggtgagttgttgatggatgctcttggcggagagactacgtttgctgatgtccagggtgacaactttgtacctgcttgcacgcttggtgtgggccaaaaagccaggttaacatacggtcaggacgtgaacacgttgaaatacttcacaacatgtggtctgcaggagggatatgaaccattttgtgtcaatatgaagagagacgtgactcactggtatactaaagatcagccaatcttcgagaatactgatgagatgatcgacaccagaattgatgtcaccaggataccagctggttcagatacacctccatgcctcaagatttcccacaacacgttcgagacgatggagaaagctaactgggagttcttacgtctctcactgcctgtcatctgccataacgagttcattgacgaggcagaaaaagccagacgttgggtagaaatcaaggaccgccaacagattttaatgaaagaggcagttgaagctcagatgcctgcccatattgaccagatcatgaggagtgggttcaccatgaacgatatcaaaggtttgcactacgaagacaatcaggaagagttgcccagctccaagatgaagcgcctgccttcaaggccaccacgtaagggatccatgaccagaggtcaagtcaacggcatgcaccggtcgaccagtgaagctgaaatggccaagtatgacttgggagcgcaaggtttgacgcctgatgacaagaaggataagaggggacgatcgcctttcaagttcttccgaagcaagcgcggcgaaagcagtgatcgtgctaaatcccgtaaatccaaaacaccagaccccttcagcgataccgaggtatcaccagaacgtggtgctcgaaggcccaaccctcagatcaaagtgtcacagtcgaacgctcagatggcgacgcccacgcaagacaggaagcagatgacgacgagcactctcgcgcagtcggctacggaaactgtcggcaatgagatcttcgatgcagagtgcttgaagctcatcaatgagtacttttatggagtcaggatctacccaggtcaggacccaacacacgtgtacatcggttgggtgaccacccagtaccacttgcactctaaggacttcaaccagagcaaggtcaccaagtcctctgtcatcatcattgatgattacgatagggttgttgagaacgtaaaccggcagtcgtgctacatggtgcgagctgacgagctatacaacgaggtgatggcggaagccacggccaagggcgcctcgcaaggcatgttcatcggctgctccgtcgacacctccaccggcagcgtgtccttcacctgcgaggggaaggacaccagcttcaagtttaagatggaaccagaaaccaaactgttccccgcgatcttcgtagaagcgacctccaaggagatcctgcagatagagctgggcagatcagccaccagccttccactatcagccgctgtactacctacgagtgataagcatgtcataccacagttcccgccgaggttgaaggtgcagtgcttgaaaccacatcagtgggctagggtaccgaaccaatctctacaagtgcacgctctgaagttgtccgacatccgcggttggtcgatgctgtgtgaagacgcggtttctatgctagctttgcatataccggaggaagatcgttgcatagacattttggagctgatagaaatggacaaacttttaagtttccattctcacaccctcacgttatacgctgctttatgttaccagagtaactacagggcggcccacgctctgtgcacgcacgtggaccagaagcagctgctgtacgcgatccagtcgcagtacatgtcgggcccgctgcgccagggcttctacgatctgctcatagcgctgcatctcgagtcgcatgccaccaccatggaggcgtgtaagaacgagttcgtgatcccgctgggcccggagctgaaggcgctgtacgaggagcccgacatgggacactcgctgcgctcgctgcagaccgagagcgtgcgcccgcagatgaagatgaccgatatcgctgaaagtataaccgagatcagcaacctgtactcgccgtacttcccgctggaggtggtacgcgagttcgtgatgcaggcgctggctgaagctgtggagaccaaccaggtgcacaaccgggatcctgtaggggggagcaatgagaacctgttcctgcctctaataaagttggtggaccgtctcctgctggtcggcatgatgcgcgacgaggatgtggagaagctactcatcatgaccaaccctgagacatgggacccctcgtttgataaagagggtaaagacgagcaccgcaaaggtctactccacatgaaaatggcggaaggcgctaagctgcagatgtgttacttactgcaacatctcaacgacatacagctgcggcacagggtcgaagctatcattgcgtttgcgcatgacttcgtcggtgatctacaaactgatcagctcagacgttacacggaaatcaagcagtctgatttgccgagcgcagttgccgctaagaagaccagagagttccgttgtccgcctagagaacagatgaacgctatactgagtttcaagcacctagaagaggaggacaaggagaactgtccgtgcggcgaggagctgatcgcgcgcatgaacgagttccacgacaccctcatggcgcacgtctcgctgcacgcgctgcaggagcctgatgctgcggaaaatcaagaaccagaagcaaaaccgggcgcattcggcaagttatacaacattatcaacacggtaaaggaattggaagaagaagctaaggcaattgaagagcctccgaagaagacgcctgaggagaagttccgtaaggtcctcatccagaccatagtgaactgggctgaggagtcgcagatagaaacacccaaactcgtcagagaaatgttcagccttctagtccgccagtacgacgcagtaggtgagctgatccgcgctctagagaagacatacgtcatcaacgcgaagaccaagttagatgtcgcggagatgtgggtggggctcagccagatccgagccctcctgccggtgcagatgagccaggaggaagaggaactcatgaggaagaggctctggaaacttgtgaacaaccatacgttcttccagcatccagatttaatcagggtgctccgcgtgcacgagaacgtgatggcggtgatgatgaacacgctcggccgccgcgcgcaggcgcagtccgacgcgcagccctcctcacagcctgtcgcagaggacaacaaggagaaggacacatcacacgagatggtggtagcttgctgccgtttcctctgctacttctgccgcaccgggagacagaaccagaaggccatgttcgaccacttcgacttcctcctggagaactccaacatcttgctgtccagaccttcgctgagaggatccacgcctctggacgtggcttactccagtcttatggagaatactgaactggccctggctttgagagagcattacctggagaagatagcagtgtacctgtcccgctgcggcctgcagagcaactcggagctggtggagaaggggtaccctgacctcggctgggatccagtcgagggggagcggtatcttgacttcctgaggttctgtgtttgggtaaacggggaaagcgtagaagaaaacgcgaatctggtgatccgtctgctgatccgtcgtccggagtgcctcgggccggcgctgcgcggcgagggcgagggcctgctgaaggccatcgtcgacgccaacaagatgagcgagaggatcgccgacaggaggaagctcagggaaatggagcaggagggagatgttaacttcagccaccctctcccggagtcggatgaggatgaggactacatcgacacgggcgccgccatcttgaacttctactgtacgttggtagatctgctcggaagatgtgctcctgatgctggcgttattgctctcggcaagaacgagtctctccgtgcccgcgctatcctgcggtcgctggtgccgctggaggacctgcagggagtgctgagcctgcgcttcacgctcaacaaccctgctgctggagaggaacgacccaagtctgatatgccatcgggtctaatcccgggacacaagcagagcgtgggactgttcctggagagagtgtatggcatcgaaactcaggagttgttctacaaactgctggaggaagccttcctgccagaccttagggctgccactatgctggacaggaacgacggctgcgagtcagacatggccctgtcgatgaaccgctacatcggcaactcgatcctgccgctgctgatcaagcacgcgtacttctacaacgaagctgagaactacgccagtttactggatgccacgctacatactgtttataggttatcgaagaaccgcatgttaaccaagggccaacgtgaagcggtgtcagacttcctcgtggcgcttacttcagccatgcagccgtctatgttgctcaagctgctgagaaaattgacagtcgacgtgtctaaactgtccgagtataccactgtcgctcttaggctgctgacgctgcactacgagcgctgcgcgaagtactacggcagcacgggcgcggggcagggcgcgttcggcgcgtcgtcggacgaggagaagcgcctcaccatgatgctcttctccaacatcttcgactcgctcagcaagatggactacgagcccgagctcttcgggaaggcgctgccctgtcttattgctataggatgcgctctgcctcctgactactctctctcaaagaactatgatgacgagttttacggcaaggagcaagctgcaggtgatttagacaaccctcaatacgaccctcagcccataaacacgtcctcagtagcattaaacaatgatctcaacaccatcgtacagaagttctcggaacattaccacgatgcgtgggctagtaggaagattgagaacggctgggtgtacggggagggctggtctgatagccagaagactcaccctaggctgaagccttataatatgcttaatgattatgaaaaagagcgttacaaggagccagtacgtgaatctctgaaggcacttctagccatcggttggtctgtagaacattcagaagtagacataccgagtaacaaccgaagctccatgagaaggcagtccaagtcgggaggccgccctcccgaaattgtgacagactcggcgactccgttcaactacaaccctcacccagtcgacatgaccaacttgacgctatcgagggagatgcagaacatggcggagaggctcgctgacaacgcacatgacatctgggcgaagaagaagaaggaagaacttgttactaatggaggtggcatccacccccaactagtaccctacgacctcctaacagacaaagaaaagaagaaagatcgagaacgttctcaggagttcctcaaatacctacagtaccaagggtacaagctccaccggcccagcaaggcgccacaaagtgatacggaacaaaccactacgggggttgcaatagagttgagattcgcatactcgctcctcgagaaattgatccagtacatcgatagggccaccattaatatgaagcttttgaaaccttcgactacattcagtaggagaagtagttttaagactagtaccagggatattaagttcttttctaaggtggtgctgcctctaatggagaagtatttctcgacgcatcgtaactacttcatagctgtagctacggcgacgaataatgttggtgcagcaagcctgaaggagaaggagatggtagctgctctgttctgtaagctggctagcttgcttagatctagactcgcagctttcggtcctgacgtccgcatcacagtccgctgtctccaagtgttggtgaagggcatcgacgccaagtccttagtgaagaactgccccgagttcatcaggacctccatgttgaccttcttcaacaatgtcgctgatgatgtagggcataccatcatgaatttacaggatggtaaatacgcgcaccttcgaggtacacatttgaagacgtccacgtccctgggctatatcaatggagtactgctccccatactgacggccaagttcgaccatctggctaactgcgagtacggtgctgatctgttgttggacgagatacaagtggcgtcatacaagatgttgggctccctgtacgcgctcggcacggacgcttcgctcacacacgacagaaagtacctcaagactgagattgagagacataaacctgctttgggttcgtgtctaggtgcgttcagttcgacattcccagtggcgttcttggaacctcacctgaacaaacacaaccagttctccttgctgaacaggatcgctgaccattctttggaagcccaagacataatgcagaaaatggaacaatgcatgccgacgctagagacgatcttaggcgaggtggaccaattcgtggagtcagacaagacgtacaacgaggcgccgcatatcatcgatgtggtgctgcctttactctgttcttatttgccgttctggtgggcacaggggcctgataatgttactcctactggcggaaaccacgtaacaatggtaacagcggaacacatgaaccagctcctcaagaatgttctgaagctcatcaaaaagaacatcggcaatgagaacgcgccgtggatgacccgcatcgccacctacacgcagcagatcatcatcaacagctccgaggaactgctgagggattccttcctgccgctcgctgaacgtgttcgcaaacgcacggacaatatgttccataaggaggagagcttgagagggtttattaagtcgtcaacagacgacacatcccaggtagagtctcagatacaagaagactggcagctgctggtcagagacatctactccttctacccgctgctcatcaagtacgtcgacctgcagaggaaccactggctcaggaacaatgttccagaggcggaagagctgtacaaccacgtggctgaaatcttcaacatctggtcgaagagccagtacttcttgaaggaggaacagaacttcatctctgccaacgaaattgataacatggtgctgattatgccaacagcaacaagaagagtgacagcagtaacagatggtactcctcaaggtggtggaaagaaaaagaagaagcaccgtgataagaaacgcgacaaagacaaggaagtccaagcgtccctaatggtagcttgtctgaagaggttgttaccagttggccttaacctattcgctggcagagaacaagaactggtgcagcattgtaaagacaggttcctgaagaaaatgtcagaacaagatgtggcagaattcgcgaagacccagctgacacttccagataaaatagatccggcagacgaaatgtcttggcaacattacttgtatagcaagttaggttcgaagagtaagagcaatataactgtggaaactgctgaaaataaggccaagattattgatgataccgtcgagagaatcgtcgctatgagtaaagtgcttttcggattgcatatgatcgaccatccccaacaaatgagtaagaacgtgtaccggtcggtggtgtcgatacaacgcaagcgcgccgtcatcgcctgcttccgacaaacttcactacattctctgccgagacatcgagcgtgtaacatcttcgctcgcacgtactacgagctctggctggaagaggagaacattggacaagaagtaatgatagaagatcttactcaatcattcgaagacgcagagctgaagaagagtgacgtggtggaggaaggtgagaagcctgaccccctcacgcagctggtcaccaccttctgtcgcggtgccatgactgagaggtccggcgctttgcaggaggatcctctatacatgtcttacgcacacatcatagcgaagtcctgtggagaagaagaggaagaagggggtggggaggaagaggaagggggtggagaagcagaggctgaagacgaaggcagagccagtatacacgaacaagaaatggagaaacaaaagctcctattccaccaagcgcggctggcggaccgtggggttgccgaaatggtgttgctgcacatctccgcgtccaaaggcctgcccagcgagatggtcatgaagactttacagctcggtattagtatactgaggggcggcaatattgatatacagatgggtatgttgaaccacttgaaagacaagaaagacgtgggcttctttacgtccatcgccggcctcatgaactcctgctccgtgctcgatcttgacgccttcgagaggaacaccaaggctgaaggtctgggcgtgggtctggaaggtgcggcgggagagaagaacatgcatgacgccgagttcacctgcgcactcttcaggttcattcagctcacctgtgaaggacacaacttggactggcagaactacctgcgaactcaggccggtaacacgacaacagtgaacgtggtcatctgcaccgtcgactacctgctgcggctgcaggagtccatcatggacttctactggcactactcaagcaaggaactgatcgacccggccggcaaagcgaacttcttcaaggccattggcgtggcttcccaagtattcaacaccctcactgaagtcatacagggaccttgtacgcagaatcagcaggctttggctcactccaggttgtgggacgctgtcggtggtttcctgttcctattctcccacatgcaggacaagttgtcgaagcactcgtcgcaggtggacctgctgaaggaactcctcaatctgcagaaggacatgatcaccatgatgctgtccatgcttgaaggaaatgttgttaatggtacaatcggcaagcaaatggtggacacactagtagaatcggcctccaacgtggaactgatcctgaaatacttcgacatgttcctcaagctgaaggacctgacctccagcgccagcttccaggagattgatgccaataacgacggctgggtgctgcccaaggacttcaaggagaaaatggaacaacagaagagttatactcccgaagaaatcgagttcctcctagcttgctgcgagacgaaccacgacggcaagttagactacatcggtttctgcgaccgtttccacgagcctgccaaggagatcgggtttaacttggccgtgttactgactaacttgtctgaacatatgccgaacgagcctagattggcacgtttcctggagacggcaggttcagtcctgaactacttcgaaccattcctgggccgtatcgagatcatgggcggctccaagcgcatcgagcgtgtctacttcgagatcaaggagtctaatatagaacagtgggagaaaccgcaaattaaggaatccaaacgcgcgttcttctacagcatagtaacagaaggtggtgataaggaaaaattggaggctttcgtgaacttctgtgaggacgccatctttgaaatgacgcacgcgtcgggactgatggccgcgtccgaagagtcggtgggagggaccaagaatagagaggccagctatatgtatatgggggatgatgatgatgagagagccggcaaagatccattccgtcgcggactccagtcagtcaaagacggcgtcgccacggcattttcatccttatctccttccaacataaaggcgaaaatcgcagacatgcagcaaatgccaccagccgaactagctgtgggcttcttcaaaatgttcttctatctattctattacttgggctatggagttctcgtcgttgtcaggtatatattcggtgtgctcttgggtctgatgcgaggtcctcagacggatgaaccgcctccggagccgacggaagaggagaaaatcggtcagttgagacacaggttgctagcgacacaaagttctcgacatctcccggcgttgcctccagctgatgatacgggacagatgcaagtgccggcattcggactcgatatcaccaaagaagacaatggacagatacaagtaaaacctcacgaatcacccagcacatccactccatcatcaggcgaggaggcggaggtgtcacccgacgagagcgccgaccacacggaggagcagagaccgccttctcttatcgacctgcttggtggggaacaagctaaaaagcaagctcaggagaggatggaagctcaagctgctcaacaagctgccatgtcggccattgaagctgaaagcaaaaaggcagtgcaagggcccgcaccatcagcgctatctcaagtggacctgtcccagtacacccggcgcgcagtctcgttcctagctcgcaacttctacaacctgaagtacgtggcgctcgtgctggccttctgtatcaacttcgtgctgctcttctataaggtatctaccctggatggtgaaggtggtgaaggttcaggtctgggtgacatcatcgccggtgggggttccggatccggggctggctctggcagtggagacggtagcggcgagtcaggggaagatgacgacgcgttagaagtagtacacatagacgaagacttcttctatatggaacacgtcatcaagatggcggccgtgctgcactctatcgtgtctctggctatactcatcggatattatcatcttaaggtgccgctagccatcttcaaacgtgagaaggagatcgctcgtaagctggaattcgacgggctgtacatcgctgaacggcctgaagacgacgacctcaagagccactgggacaagctcgttatatctgccaaatcattccccgtaaactactgggacaagtttgtgaagaagaaggttcgcgccaaatactcggagacatatgacttcgactccatctccaacatgttgggcatggagaagacttccttctccgcgcaagaagaagaaggcagcaaaggacttattcattacataatcaacatagactggcgctaccaagtgtggaaggccggcgtgacgatcacagacaactcgttcctctactcgctatggtacttctccttctccgtgatggggaacttcaacaacttcttcttcgcggcacatttgttggacgtggctgttgggtttaagaccctgaggactatcttgcagtctgtcacgcataatggaaaacagctggtattaacggtgatgctgctgactataatcgtgtacatctacacggtgatcgcgttcaacttcttccgcaagttctacgtgcaggaggaggacgacgaagtcaataggaactgccatgacatgttgacgtgcttcgtgttcaacttgtacaagggtgtgcgggcgggcggcggcatcggcgacgagctggagccgcctgatggagacgactccgaggtctaccgcatcatcttcgacatctccttcttcttcttcatcatcgttatcctgctcgctatcctgcagggtttgatcatcgacgcgttcggagagctgcgtgaccagttggagtcggtcaaggaggacatggagtccaactgcttcatctgcggcatcaataaagactattttgataaagtgccgcacgggttcgacacacacgtgcaaagggaacacaatttagctaattacatgttcttcctcatgcatctcattaataaacccgatacggagtatacaggtcaagaaacctacgtatggaacatgtacacacaaagatgttgggactttttccccgtgggagattgtttccgaaagcaatacgaagacctcatgggagaatag

SEQ ID NO: 146 - protein, 5100 aa, Heliothis virescens
  pXL-Hv6
MAEAEGGASEQDDVSFLRTEDMVCLSCTATGERVCLAAEGFGNRHCFLENIADKNIPPDLSQCVFVIEQALSVRALQELVTAAGSETGKENLGKGTGSGHRTLLYGNAILLRHLNSDMYLACLSTSSSQDKLAFDVGLQQHSQGEACWWTLHPASKQRSEGEKVRVGDDLILVSVATERYLHTTKENEVSIVNASFHVTHWSVQPYGTGISRMKYVGYVFGGDVLRFFHGGDECLTIPSTWTKDGGQNIVVYEGGSVMSQARSLWRLELARTKWAGGFINWYHPMRIRHITTGRYLGVNDQNELYLVSREEATTASCAFCLRQEKDDQKQVLEDKDLEVIGAPIIKYGDSTVIVQHSETGLWLSYKSYETKKKGVGKVEEKQAILHEEGKMDDGLDFSRSQEEESRTARVIRKCSSLFTKFINGLETLQENRRHSMFFASVNLGEMVMCLEDLINYFAQPDEDMEHEEKQNKFRALRNRQDLFQEEGILNLILEAIDKINVITSQGFLAGFLAGDESGQSWEMISGYLYQLLAAIIKGNHTNCAQFANSNRLNWLFSRLGSQASGEGTGMLDVLHCVLIDSPEALNMMRDEHIKVIISLLEKHGRDPKVLDVLCSLCVGNGVAVRSSQNNICDYLLPGKNLLLQTALVDHVSSVRPNIFVGRVEGSAVYRKWYFEVTMDHIEKTTHMMPHLRIGWANTTGYVPYPGGGEKWGGNGVGDDLYSYGLDGAYLWSGGRKTPVNRTHAEEPYIRKGDVIGCALDLTVPIINFMFNGVRVTGSFTNFNLEGMFFPVISCSSKLSCRFLLGGEHGRLRYAAPEGYSPLVESLLPQQILSLEPCFYFGNLSKRALAGPPLVQDDTAFVPTPVDTLQITLPTYVEQIRDKLAENIHEMWAMNKIEAGWMYGDQREDLHKIHPCLVPFERLPPAEKRYDIQLAVQTLKTILALGYYISLDKPPARIRNVRLPNEPFMQSNGYKPAPLDLSAVTLTPKMDELVDQLAENTHNLWARERIQQGWTYGLNEDSDMHRSPHLVPYPKVDDAIKKANRDTASETVRTLLVYGYMLDPPTGEQHEALLLEASKQKQADFRTYRAEKNYAVSSGKWYFEFEILTAGPMRVGWAHADMAPGMMLGQDENSWAFDGYNEEKVYSGNTESFGKQWAVGDVVGVFLDLIDKTISFSLNGELLMDALGGETTFADVQGDNFVPACTLGVGQKARLTYGQDVNTLKYFTTCGLQEGYEPFCVNMKRDVTHWYTKDQPIFENTDEMIDTRIDVTRIPAGSDTPPCLKISHNTFETMEKANWEFLRLSLPVICHNEFIDEAEKARRWVEIKDRQQILMKEAVEAQMPAHIDQIMRSGFTMNDIKGLHYEDNQEELPSSKMKRLPSRPPRKGSMTRGQVNGMHRSTSEAEMAKYDLGAQGLTPDDKKDKRGRSPFKFFRSKRGESSDRAKSRKSKTPDPFSDTEVSPERGARRPNPQIKVSQSNAQMATPTQDRKQMTTSTLAQSATETVGNEIFDAECLKLINEYFYGVRIYPGQDPTHVYIGWVTTQYHLHSKDFNQSKVTKSSVIIIDDYDRVVENVNRQSCYMVRADELYNEVMAEATAKGASQGMFIGCSVDTSTGSVSFTCEGKDTSFKFKMEPETKLFPAIFVEATSKEILQIELGRSATSLPLSAAVLPTSDKHVIPQFPPRLKVQCLKPHQWARVPNQSLQVHALKLSDIRGWSMLCEDAVSMLALHIPEEDRCIDILELIEMDKLLSFHSHTLTLYAALCYQSNYRAAHALCTHVDQKQLLYAIQSQYMSGPLRQGFYDLLIALHLESHATTMEACKNEFVIPLGPELKALYEEPDMGHSLRSLQTESVRPQMKMTDIAESITEISNLYSPYFPLEVVREFVMQALAEAVETNQVHNRDPVGGSNENLFLPLIKLVDRLLLVGMMRDEDVEKLLIMTNPETWDPSFDKEGKDEHRKGLLHMKMAEGAKLQMCYLLQHLNDIQLRHRVEAIIAFAHDFVGDLQTDQLRRYTEIKQSDLPSAVAAKKTREFRCPPREQMNAILSFKHLEEEDKENCPCGEELIARMNEFHDTLMAHVSLHALQEPDAAENQEPEAKPGAFGKLYNIINTVKELEEEAKAIEEPPKKTPEEKFRKVLIQTIVNWAEESQIETPKLVREMFSLLVRQYDAVGELIRALEKTYVINAKTKLDVAEMWVGLSQIRALLPVQMSQEEEELMRKRLWKLVNNHTFFQHPDLIRVLRVHENVMAVMMNTLGRRAQAQSDAQPSSQPVAEDNKEKDTSHEMVVACCRFLCYFCRTGRQNQKAMFDHFDFLLENSNILLSRPSLRGSTPLDVAYSSLMENTELALALREHYLEKIAVYLSRCGLQSNSELVEKGYPDLGWDPVEGERYLDFLRFCVWVNGESVEENANLVIRLLIRRPECLGPALRGEGEGLLKAIVDANKMSERIADRRKLREMEQEGDVNFSHPLPESDEDEDYIDTGAAILNFYCTLVDLLGRCAPDAGVIALGKNESLRARAILRSLVPLEDLQGVLSLRFTLNNPAAGEERPKSDMPSGLIPGHKQSVGLFLERVYGIETQELFYKLLEEAFLPDLRAATMLDRNDGCESDMALSMNRYIGNSILPLLIKHAYFYNEAENYASLLDATLHTVYRLSKNRMLTKGQREAVSDFLVALTSAMQPSMLLKLLRKLTVDVSKLSEYTTVALRLLTLHYERCAKYYGSTGAGQGAFGASSDEEKRLTMMLFSNIFDSLSKMDYEPELFGKALPCLIAIGCALPPDYSLSKNYDDEFYGKEQAAGDLDNPQYDPQPINTSSVALNNDLNTIVQKFSEHYHDAWASRKIENGWVYGEGWSDSQKTHPRLKPYNMLNDYEKERYKEPVRESLKALLAIGWSVEHSEVDIPSNNRSSMRRQSKSGGRPPEIVTDSATPFNYNPHPVDMTNLTLSREMQNMAERLADNAHDIWAKKKKEELVTNGGGIHPQLVPYDLLTDKEKKKDRERSQEFLKYLQYQGYKLHRPSKAPQSDTEQTTTGVAIELRFAYSLLEKLIQYIDRATINMKLLKPSTTFSRRSSFKTSTRDIKFFSKVVLPLMEKYFSTHRNYFIAVATATNNVGAASLKEKEMVAALFCKLASLLRSRLAAFGPDVRITVRCLQVLVKGIDAKSLVKNCPEFIRTSMLTFFNNVADDVGHTIMNLQDGKYAHLRGTHLKTSTSLGYINGVLLPILTAKFDHLANCEYGADLLLDEIQVASYKMLGSLYALGTDASLTHDRKYLKTEIERHKPALGSCLGAFSSTFPVAFLEPHLNKHNQFSLLNRIADHSLEAQDIMQKMEQCMPTLETILGEVDQFVESDKTYNEAPHIIDVVLPLLCSYLPFWWAQGPDNVTPTGGNHVTMVTAEHMNQLLKNVLKLIKKNIGNENAPWMTRIATYTQQIIINSSEELLRDSFLPLAERVRKRTDNMFHKEESLRGFIKSSTDDTSQVESQIQEDWQLLVRDIYSFYPLLIKYVDLQRNHWLRNNVPEAEELYNHVAEIFNIWSKSQYFLKEEQNFISANEIDNMVLIMPTATRRVTAVTDGTPQGGGKKKKKHRDKKRDKDKEVQASLMVACLKRLLPVGLNLFAGREQELVQHCKDRFLKKMSEQDVAEFAKTQLTLPDKIDPADEMSWQHYLYSKLGSKSKSNITVETAENKAKIIDDTVERIVAMSKVLFGLHMIDHPQQMSKNVYRSVVSIQRKRAVIACFRQTSLHSLPRHRACNIFARTYYELWLEEENIGQEVMIEDLTQSFEDAELKKSDVVEEGEKPDPLTQLVTTFCRGAMTERSGALQEDPLYMSYAHIIAKSCGEEEEEGGGEEEEGGGEAEAEDEGRASIHEQEMEKQKLLFHQARLADRGVAEMVLLHISASKGLPSEMVMKTLQLGISILRGGNIDIQMGMLNHLKDKKDVGFFTSIAGLMNSCSVLDLDAFERNTKAEGLGVGLEGAAGEKNMHDAEFTCALFRFIQLTCEGHNLDWQNYLRTQAGNTTTVNVVICTVDYLLRLQESIMDFYWHYSSKELIDPAGKANFFKAIGVASQVFNTLTEVIQGPCTQNQQALAHSRLWDAVGGFLFLFSHMQDKLSKHSSQVDLLKELLNLQKDMITMMLSMLEGNVVNGTIGKQMVDTLVESASNVELILKYFDMFLKLKDLTSSASFQEIDANNDGWVLPKDFKEKMEQQKSYTPEEIEFLLACCETNHDGKLDYIGFCDRFHEPAKEIGFNLAVLLTNLSEHMPNEPRLARFLETAGSVLNYFEPFLGRIEIMGGSKRIERVYFEIKESNIEQWEKPQIKESKRAFFYSIVTEGGDKEKLEAFVNFCEDAIFEMTHASGLMAASEESVGGTKNREASYMYMGDDDDERAGKDPFRRGLQSVKDGVATAFSSLSPSNIKAKIADMQQMPPAELAVGFFKMFFYLFYYLGYGVLVVVRYIFGVLLGLMRGPQTDEPPPEPTEEEKIGQLRHRLLATQSSRHLPALPPADDTGQMQVPAFGLDITKEDNGQIQVKPHESPSTSTPSSGEEAEVSPDESADHTEEQRPPSLIDLLGGEQAKKQAQERMEAQAAQQAAMSAIEAESKKAVQGPAPSALSQVDLSQYTRRAVSFLARNFYNLKYVALVLAFCINFVLLFYKVSTLDGEGGEGSGLGDIIAGGGSGSGAGSGSGDGSGESGEDDDALEVVHIDEDFFYMEHVIKMAAVLHSIVSLAILIGYYHLKVPLAIFKREKEIARKLEFDGLYIAERPEDDDLKSHWDKLVISAKSFPVNYWDKFVKKKVRAKYSETYDFDSISNMLGMEKTSFSAQEEEGSKGLIHYIINIDWRYQVWKAGVTITDNSFLYSLWYFSFSVMGNFNNFFFAAHLLDVAVGFKTLRTILQSVTHNGKQLVLTVMLLTIIVYIYTVIAFNFFRKFYVQEEDDEVNRNCHDMLTCFVFNLYKGVRAGGGIGDELEPPDGDDSEVYRIIFDISFFFFIIVILLAILQGLIIDAFGELRDQLESVKEDMESNCFICGINKDYFDKVPHGFDTHVQREHNLANYMFFLMHLINKPDTEYTGQETYVWNMYTQRCWDFFPVGDCFRKQYEDLMGE

SEQ ID NO: 147 - DNA, 30 bp, artificial sequence
  PCR forward intron primer
cagtaaagcttgagtcatggaaatttagac

SEQ ID NO: 148 - DNA, 27 bp, artificial sequence
  PCR reverse intron primer
tctggatcctggtttggaaaatgggga

SEQ ID NO: 149 - DNA, 459 bp, artificial sequence
  intron
gtgagtcatggaaatttagactttattgtaatactgatagggtataggtttaaatgtttactacgttatttagttacttcatgacgatgacgattaaaaatgttatatgttacatgcagaaaactgtggatatgtttatggtatgtattttaaattaggtttcactattccgtgttcgttagataaatctatcggcatccgatgctttcgtggatatttcagaggttacccaaaattacaatcgattgccaagtctctttcgcttttaattagctgttcacagtggttccaagcacgacccgaggaatctacttcacgcaccttgatgaaaaaccattctctggttctggactaactgtgttccaattaaatcagttcaatattttattgtaacagacaaacagattaagttaataatattagcaaggattataaataaactcccattttccaaaccag

What is claimed is:

1. An isolated nucleic acid comprising:
   (a) a nucleic acid sequence encoding a ryanodine receptor having an amino acid sequence identity of at least 80% when compared to SEQ ID NO: 128; or
   (b) the complement of (a), wherein the complement and the nucleotide sequence have the same number of nucleotides and are 100% complementary.

2. The isolated nucleic acid of claim 1 wherein the sequence identity is at least 85%.

3. The isolated nucleic acid of claim 1 wherein the sequence identity is at least 90%.

4. The isolated nucleic acid fragment of claim 1 wherein the sequence identity is at least 95%.

5. The isolated nucleic acid of claim 1 wherein said nucleic acid encodes a ryanodine receptor comprising the amino acid sequence of SEQ ID NO: 128.

6. An isolated nucleic acid comprises the nucleotide sequence of SEQ ID NO: 127.

7. A recombinant construct comprising the isolated nucleic acid of claim 1 or 5 operably linked to at least one regulatory sequence.

8. A transformed host cell comprising the recombinant construct of claim 7.

9. The host cell of claim 8 wherein said cell is selected from the group consisting of *E.coli*, yeast, Sf9, Sf21, S2, Xenopus oocytes, HEK-293 and CHO.

* * * * *

UNITED STATES PATENT AND TRADEMARK OFFICE
CERTIFICATE OF CORRECTION

PATENT NO.       : 7,205,147 B2                                        Page 1 of 1
APPLICATION NO.  : 10/668767
DATED            : April 17, 2007
INVENTOR(S)      : Steven Gutteridge et al.

It is certified that error appears in the above-identified patent and that said Letters Patent is hereby corrected as shown below:

Title page of patent, Item (75) Inventors section: add "James J. Rauh, Conowingo, MD".

Last page of patent, Claims section: Claim 4, delete "fragment".

Last page of patent, Claims section, Claim 6, delete "comprises" and insert therefor --comprising--.

Signed and Sealed this

Twentieth Day of November, 2007

JON W. DUDAS
*Director of the United States Patent and Trademark Office*